United States Patent 9,675,668 (MODIFIED POLYNUCLEOTIDES ENCODING HEPATITIS A VIRUS CELLULAR RECEPTOR 2) - sequence listing, part 8

SEQ ID NO: 9596 - protein, 327 aa, Artificial Sequence
  Description of Artificial Sequence: Synthetic coding sequence
MAAPGSCALWSYCGRGWSRAMRGCQLLGLRSSWPGDLLSARLLSQEKRAAETHFGFETVSEEEKGGKVYQVFESVAKKYDVMNDMMSLGIHRVWKDLLLWKMHPLPGTQLLDVAGGTGDIAFRFLNYVQSQHQRKQKRQLRAQQNLSWEEIAKEYQNEEDSLGGSRVVVCDINKEMLKVGKQKALAQGYRAGLAWVLGDAEELPFDDDKFDIYTIAFGIRNVTHIDQALQEAHRVLKPGGRFLCLEFSQVNNPLISRLYDLYSFQVIPVLGEVIAGDWKSYQYLVESIRRFPSQEEFKDMIEDAGFHKVTYESLTSGIVAIHSGFKL

SEQ ID NO: 9597 - protein, 246 aa, Artificial Sequence
  Description of Artificial Sequence: Synthetic coding sequence
MAAPGSCALWSYCGRGWSRAMRGCQLLGLRSSWPGDLLSARLLSQEKRAAETHFGFETVSEEEKGGKVYQVFESVAKKYDVMNDMMSLGIHRVWKDLLLWKMHPLPGTQLLDVAGGTGDINKEMLKVGKQKALAQGHDRRCRLSQGDLRKSNIRHCGHSFWLQTLIPFLSWSMNQSYPVESLELKDNLANETAAEHLLLRIRALDSCLNRTVSKWKNKFLSLFYSFLWSCFSPSPRGIWSVSLLNC

SEQ ID NO: 9598 - protein, 393 aa, Artificial Sequence
  Description of Artificial Sequence: Synthetic coding sequence
MIFTFMTRKSCCSKQVQRKYWRNCQKLTATGSAPFPLALQRFSVVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 9599 - protein, 468 aa, Artificial Sequence
  Description of Artificial Sequence: Synthetic coding sequence
MAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 9600 - protein, 443 aa, Artificial Sequence
  Description of Artificial Sequence: Synthetic coding sequence
MRGQGPPLSSFGVWLASRAASDPSRPRRQGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 9601 - protein, 146 aa, Artificial Sequence
  Description of Artificial Sequence: Synthetic coding sequence
MAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVPLYLFNFVKMSWSVLRYRSPLSPSVL

SEQ ID NO: 9602 - protein, 138 aa, Artificial Sequence
  Description of Artificial Sequence: Synthetic coding sequence
MTWWCRVEAWWALPWPVPWDMIFTFMTRKSCCSKQVQRKYWRNCQKLTATGSAPFPLALQRFSVVWDACSEALIMFDKDNLDDMGYIVENDVIMHALTKQLEAVSDRVTVLYRSKAIRYTWPCPFPMADSSPWVHITL

SEQ ID NO: 9603 - protein, 262 aa, Artificial Sequence
  Description of Artificial Sequence: Synthetic coding sequence
MIFTFMTRKSCCSKQVQRKYWRNCQKLTATGSAPFPLALQRFSVVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVAR

SEQ ID NO: 9604 - protein, 391 aa, Artificial Sequence
  Description of Artificial Sequence: Synthetic coding sequence
MIFTFMTRKSCCSKQVQRKYWRNCQKLTATGSAPFPLALQRFSVVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKIMAFASK

SEQ ID NO: 9605 - protein, 155 aa, Artificial Sequence
  Description of Artificial Sequence: Synthetic coding sequence
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERPAGASEHEAMDHPRAAAR

SEQ ID NO: 9606 - protein, 137 aa, Artificial Sequence
  Description of Artificial Sequence: Synthetic coding sequence
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFER

SEQ ID NO: 9607 - protein, 139 aa, Artificial Sequence
  Description of Artificial Sequence: Synthetic coding sequence
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERSF

SEQ ID NO: 9608 - protein, 256 aa, Artificial Sequence
  Description of Artificial Sequence: Synthetic coding sequence
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERVTTLAGAQQELLNMKLWTIHELLQDSKPDKDMEASEPEASRPLPEDFCLKEDEEEIGDSQAWEEPTNWSTETWNLATSWEVGRGLRRRCSQAVAKGPSHSLGWEGGTTAEGRLKQSLFS

SEQ ID NO: 9609 - protein, 119 aa, Artificial Sequence
  Description of Artificial Sequence: Synthetic coding sequence
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSGGFSRSLCWVGGV

SEQ ID NO: 9610 - protein, 283 aa, Artificial Sequence
  Description of Artificial Sequence: Synthetic coding sequence
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERVTTLAGAQQELLNMKLWTIHELLQDSKPDKDMEASEPGEGSGGESAGGGDKVSETGTFLISPHTEASRPLPEDFCLKEDEEEIGDSQAWEEPTNWSTETWNLATSWEVGRGLRRRCSQAVAKGPSHSLGWEGGTTAEGRLKQSLFS

SEQ ID NO: 9611 - protein, 336 aa, Artificial Sequence
  Description of Artificial Sequence: Synthetic coding sequence
MLQRGLWPWRTRLLPTPGTWRPARPWPLPPPPQVLRVKLCGNVKYYQSHHYSTVVPPDEITVIYRHGLPLVTLTLPSRKERCQFVVKPMLSTVGSFLQDLQNEDKGIKTAAIFTADGNMISASTLMDILLMNDFKLVINKIAYDVQCPKREKPSNEHTAEMEHMKSLVHRLFTILHLEESQKKREHHLLEKIDHLKEQLQPLEQVKAGIEAHSEAKTSGLLWAGLALLSIQGGALAWLTWWVYSWDIMEPVTYFITFANSMVFFAYFIVTRQDYTYSAVKSRQFLQFFHKKSKQQHFDVQQYNKLKEDLAKAKESLKQARHSLCLQMQVEELNEKN

SEQ ID NO: 9612 - protein, 562 aa, Artificial Sequence
  Description of Artificial Sequence: Synthetic coding sequence
MDLPEGPVGGPTAEMYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAEKEQQHLVAEMETLQEENGKLLAERDGVKKRSQELAMEKDTLKRQLFECEHLICQRDTILSERTRDVESLAQTLEEYRVTTQELRLEISRLEEQLSQTYEGPDELPEGAQLRRVGWTELLPPSLGLEIEAIRQKQEVATADLSNPLCGVWQWEEVIHETSEETEFPSEAPAGGQRNFQGEPAHPEEGRKEPSMWLTRREEEEDAESQVTADLPVPLGAPRPGDIPENPPERPARRELQQALVPVMKKLVPVRRRAWGQLCLPPQRLRVTRHPLIPAPVLGLLLLLLLSVLLLGPSPPPTWPHLQLCYLQPPPV

SEQ ID NO: 9613 - protein, 118 aa, Artificial Sequence
  Description of Artificial Sequence: Synthetic coding sequence
MTKKKRENLGVALEIDGLEEKLSQCRRDLEAVNSRLHSRELSPEAREGTEVSSAREPEEHAALCGHLYPPDARLCLLDHVSLALPHNQHRLPLGPLIRIKQALQASIGPRCWGVPLPT

SEQ ID NO: 9614 - protein, 97 aa, Artificial Sequence
  Description of Artificial Sequence: Synthetic coding sequence
MTKKKRENLGVALEIDGLEEKLSQCRRDLEAVNSRLHSRELSPEARRSLEKEKNSLMNKASNYEKELKFLRQENRKNMLLSVAIFILLTLVYAYWTM

SEQ ID NO: 9615 - protein, 114 aa, Artificial Sequence
  Description of Artificial Sequence: Synthetic coding sequence
MTKKKRENLGVALEIDGLEEKLSQCRRDLEAVNSRLHSRELSPEAREGTEVSSAREPEEHAALCGHLYPPDARLCLLDHVSLALPHNQHRLPLGPLIRIKQALQASIGPRCWGV

SEQ ID NO: 9616 - protein, 483 aa, Artificial Sequence
  Description of Artificial Sequence: Synthetic coding sequence
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRREQKKLEKKQMKMKQIKVKAM

SEQ ID NO: 9617 - protein, 483 aa, Artificial Sequence; identical to SEQ ID NO: 9616
  Description of Artificial Sequence: Synthetic coding sequence

SEQ ID NO: 9618 - protein, 411 aa, Artificial Sequence
  Description of Artificial Sequence: Synthetic coding sequence
MMGRSPGFAMQHIVGVPHVLVRRGLLGRDLFMTRTLCSPGPSQPGEKRPEEVALGLHHRLPALGRALGHSIQQRATSTAKTWWDRYEEFVGLNEVREAQGKVTEAEKVFMVARGLVREAREDLEVHQAKLKEVRDRLDRVSREDSQYLELATLEHRMLQEEKRLRTAYLRAEDSEREKFSLFSAAVRESHEKERTRAERTKNWSLIGSVLGALIGVAGSTYVNRVRLQELKALLLEAQKGPVSLQEAIREQASSYSRQQRDLHNLMVDLRGLVHAAGPGQDSGSQAGSPPTRDRDVDVLSAALKEQLSHSRQVHSCLEGLREQLDGLEKTCSQMAGVVQLVKSAAHPGLVEPADGAMPSFLLEQGSMILALSDTEQRLEAQVNRNTIYSTLVTCVTFVATLPVLYMLFKAS

SEQ ID NO: 9619 - protein, 411 aa, Artificial Sequence; identical to SEQ ID NO: 9618
  Description of Artificial Sequence: Synthetic coding sequence

SEQ ID NO: 9620 - protein, 302 aa, Artificial Sequence
  Description of Artificial Sequence: Synthetic coding sequence
MVARGLVREAREDLEVHQAKLKEVRDRLDRVSREDSQYLELATLEHRMLQEEKRLRTAYLRAEDSEREKFSLFSAAVRESHEKERTRAERTKNWSLIGSVLGALIGVAGSTYVNRVRLQELKALLLEAQKGPVSLQEAIREQASSYSRQQRDLHNLMVDLRGLVHAAGPGQDSGSQAGSPPTRDRDVDVLSAALKEQLSHSRQVHSCLEGLREQLDGLEKTCSQMAGVVQLVKSAAHPGLVEPADGAMPSFLLEQGSMILALSDTEQRLEAQVNRNTIYSTLVTCVTFVATLPVLYMLFKAS

SEQ ID NO: 9621 - protein, 62 aa, Artificial Sequence
  Description of Artificial Sequence: Synthetic coding sequence
MMGRSPGFAMQHIVGVPHVLVRRGLLGRDLFMTRTLCSPGPSQPGEKRPEEVALGLHHRLPA

SEQ ID NO: 9622 - protein, 302 aa, Artificial Sequence; identical to SEQ ID NO: 9620
  Description of Artificial Sequence: Synthetic coding sequence

SEQ ID NO: 9623 - protein, 159 aa, Artificial Sequence
  Description of Artificial Sequence: Synthetic coding sequence
MMGRSPGFAMQHIVGVPHVLVRRGLLGRDLFMTRTLCSPGPSQPGEKRPEEVALGLHHRLPALGRALGHSIQQRATSTAKTWWDRYEEFVGLNEVREAQGKVTEAEKVFMVARGLVREAREDLEVHQAKLKEVRDRLDRVSREDSQYLELATLEHRMLQ

SEQ ID NO: 9624 - protein, 302 aa, Artificial Sequence; identical to SEQ ID NO: 9620
  Description of Artificial Sequence: Synthetic coding sequence

SEQ ID NO: 9625 - protein, 106 aa, Artificial Sequence
  Description of Artificial Sequence: Synthetic coding sequence
MASSGAGDPLDSKRGEAPFAQRIDPTREKLTPEQLHSMRQAELAQWQKVLPRRRTRNIVTGLGIGALVLAIYGYTFYSISQERFLDELEDEAKAARARALARASGS

SEQ ID NO: 9626 - protein, 144 aa, Artificial Sequence
  Description of Artificial Sequence: Synthetic coding sequence
MAAPSGGVNCEEFAEFQELLKVMRTIDDRIVHELNTTVPTASFAGKIDASQTCKQLYESLMAAHASRDRVIKNCIAQTSAVVKNLREEREKNLDDLTLLKQLRKEQTKLKWMQSELNVEEVVNDRSWKVFNERCRIHFKPPKNE

SEQ ID NO: 9627 - protein, 257 aa, Artificial Sequence
  Description of Artificial Sequence: Synthetic coding sequence
MDCGSVGGQRTQRLPGRQRLLFLPVGLSGRPGGSETSARRCLSALSDGLGALRPRAPAARGGVSRASPLLLLLLVPSPRLAAAAPRRQLGDWERSRLGYAAPPAGRSSAWRCSPGVAAAAGALPQYHGPAPALVSCRRELSLSAGSLQLERKRRDFTSSGSRKLYFDTHALVCLLEDNESHSFIQAGVQWHSLGLLQPPPPGFKRSSHLILLSSWDYRHAPPHLDNFSVFLLETGFHHVGQAGLKLLTSSDPPTLAS

SEQ ID NO: 9628 - protein, 359 aa, Artificial Sequence
  Description of Artificial Sequence: Synthetic coding sequence
MDCGSVGGQRTQRLPGRQRLLFLPVGLSGRPGGSETSARRCLSALSDGLGALRPRAPAARGGVSRASPLLLLLLVPSPRLAAAAPRRQLGDWERSRLGYAAPPAGRSSAWRCSPGVAAAAGALPQYHGPAPALVSCRRELSLSAGSLQLERKRRDFTSSGSRKLYFDTHALVCLLEDNGFATQQAEIIVSALVKILEANMDIVYKDMVTKMQQEITFQQVMSQIANVKKDMIILEKSEFSALRAENEKIKLELHQLKQQVMDEVIKVRTDTKLDFNLEKSRVKELYSLNEKKLLELRTEIVALHAQQDRALTQTDRKIETEVAGLKTMLESHKLDNIKYLAGSIFTCLTVALGFYRLWI

SEQ ID NO: 9629 - protein, 245 aa, Artificial Sequence
  Description of Artificial Sequence: Synthetic coding sequence
MLANCGSVCEETQFRGTTVAPALGEFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 9630 - protein, 153 aa, Artificial Sequence
  Description of Artificial Sequence: Synthetic coding sequence
MVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 9631 - protein, 153 aa, Artificial Sequence; identical to SEQ ID NO: 9630
  Description of Artificial Sequence: Synthetic coding sequence

SEQ ID NO: 9632 - protein, 254 aa, Artificial Sequence
  Description of Artificial Sequence: Synthetic coding sequence
MNSRQAWRLFLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 9633 - protein, 411 aa, Artificial Sequence
  Description of Artificial Sequence: Synthetic coding sequence
MPMWNKVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAVKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 9634 - protein, 405 aa, Artificial Sequence
  Description of Artificial Sequence: Synthetic coding sequence
MDDDDFGGFEAAETFDGGSGETQTTSPAIPWAAFPAVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKHQRLLEMLDTEKELLKEKIKEALIQQSQEQKEILEKCLEEERQRNKEALVSAAKLEKEAVKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 9635 - protein, 441 aa, Artificial Sequence
  Description of Artificial Sequence: Synthetic coding sequence
MDDDDFGGFEAAETFDGGSGETQTTSPAIPWAAFPAVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAVKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 9636 - protein, 361 aa, Artificial Sequence
  Description of Artificial Sequence: Synthetic coding sequence
MDDDDFGGFEAAETFDGGSGETQTTSPAIPWAAFPAVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAVKDAVLKVVEEERKNLEKAHAEERELWKTEHAKDQEKVSQEIQKAIQE

SEQ ID NO: 9637 - protein, 85 aa, Artificial Sequence
  Description of Artificial Sequence: Synthetic coding sequence
MDDDDFGGFEAAETFDGGSGETQTTSPAIPWAAFPAVSGVHLSPSSPEIVLDRDHSSSIGCLSSDAIISSPENTHAANSIVSQTI

SEQ ID NO: 9638 - protein, 405 aa, Artificial Sequence; identical to SEQ ID NO: 9634
  Description of Artificial Sequence: Synthetic coding sequence

SEQ ID NO: 9639 - protein, 91 aa, Artificial Sequence
  Description of Artificial Sequence: Synthetic coding sequence
MDDDDFGGFEAAETFDGGSGETQTTSPAIPWAAFPAVSGVHLSPSSPEIVLDRDHSSSIGCLSSDAIISSPENTHAANSIVSQTIPKAQIQ

SEQ ID NO: 9640 - protein, 441 aa, Artificial Sequence; identical to SEQ ID NO: 9635
  Description of Artificial Sequence: Synthetic coding sequence

SEQ ID NO: 9641 - protein, 118 aa, Artificial Sequence
  Description of Artificial Sequence: Synthetic coding sequence
MATPSLRGRLARFGNPRKPVLKPNKPLILANRVGERRREKGEATCITEMSVMMACWKQNEFRDDACRKEIQGFLDCAARAQEARKMRSIQETLGESGSLLPNKLNKLLQRFPNKPYLS

SEQ ID NO: 9642 - protein, 97 aa, Artificial Sequence
  Description of Artificial Sequence: Synthetic coding sequence
MATPSLRGRLARFGNPRKPVLKPNKPLILANRVGERRREKGEATCITEMSVMMACWKQNEFRDDACRKEIQGFLDCAARAQVTDGSWGAFSGKEWGR

SEQ ID NO: 9643 - protein, 142 aa, Artificial Sequence
  Description of Artificial Sequence: Synthetic coding sequence
MPRGSRSAASRPASRPAAPSAHPPAHPPPSAAAPAPAPSGQPGLMAQMATTAAGVAVGSAVGHVMGSALTGAFSGGSSEPSQPAVQQAPTPAAPQPLQMGPCAYEIRQFLDCSTTQSDLSLCEGFSEALKQCKYYHGLSSLP

SEQ ID NO: 9644 - protein, 151 aa, Artificial Sequence
  Description of Artificial Sequence: Synthetic coding sequence
MPRGSRSRTSRMAPPASRAPQMRAAPRPAPVAQPPAAAPPSAVGSSAAAPRQPGLMAQMATTAAGVAVGSAVGHTLGHAITGGFSGGSNAEPARPDITYQEPQGTQPAQQQQPCLYEIKQFLECAQNQGDIKLCEGFNEVLKQCRLANGLA

SEQ ID NO: 9645 - protein, 155 aa, Artificial Sequence
  Description of Artificial Sequence: Synthetic coding sequence
MPVSYSSVTTRYYHRAGAEEGKDRIIFVTKEDHETPSSAELVADDPNDPYEEHGLILPNGNINWNCPCLGGMASGPCGEQFKSAFSCFHYSTEEIKGSDCVDQFRAMQECMQKYPDLYPQEDEDEEEEREKKPAEQAEETAPIEATATKEEEGSS

SEQ ID NO: 9646 - protein, 142 aa, Artificial Sequence
  Description of Artificial Sequence: Synthetic coding sequence
MSYCRQEGKDRIIFVTKEDHETPSSAELVADDPNDPYEEHGLILPNGNINWNCPCLGGMASGPCGEQFKSAFSCFHYSTEEIKGSDCVDQFRAMQECMQKYPDLYPQEDEDEEEEREKKPAEQAEETAPIEATATKEEEGSS

SEQ ID NO: 9647 - protein, 482 aa, Artificial Sequence
  Description of Artificial Sequence: Synthetic coding sequence
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 9648 - protein, 146 aa, Artificial Sequence
  Description of Artificial Sequence: Synthetic coding sequence
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCI

SEQ ID NO: 9649 - protein, 350 aa, Artificial Sequence
  Description of Artificial Sequence: Synthetic coding sequence
MDSFNYTTPDYGHYDDKDTLDLNTPVDKTSNTLRVPDILALVIFAVVFLVGVLGNALVVWVTAFEAKRTINAIWFLNLAVADFLSCLALPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTGIMMSFLEPSSPTFLLLKKLDSLCVSFAYINCCINPIIYVVAGQGFQGRLRKSLPSLLRNVLTEESVVRESKSFTRSTVDTMAQKTQAV

SEQ ID NO: 9650 - protein, 158 aa, Artificial Sequence
  Description of Artificial Sequence: Synthetic coding sequence
MAFMVKTMVGGQLKNLTGSLGGGEDKGDGDKSAAEAQGMSREEYEEYQKQLVEEKMERDAQFTQRKAERATLRSHFRDKYRLPKNETDESQIQMAGGDVELPRELAKMIEEDTEEEEEKASVLGQLASLPGLNLGSLKDKAQATLGDLKQSAEKCHVM

SEQ ID NO: 9651 - protein, 713 aa, Artificial Sequence
  Description of Artificial Sequence: Synthetic coding sequence
MEPVETWTPGKVATWLRGLDDSLQDYPFEDWQLPGKNLLQLCPQSLEALAVRSLGHQELILGGVEQLQALSSRLQTENLQSLTEGLLGATHDFQSIVQGCLGDCAKTPIDVLCAAVELLHEADALLFWLSRYLFSHLNDFSACQEIRDLLEELSQVLHEDGPAAEKEGTVLRICSHVAGICHNILVCCPKELLEQKAVLEQVQLDSPLGLEIHTTSNCQHFVSQVDTQVPTDSRLQIQPGDEVVQINEQVVVGWPRKNMVRELLREPAGLSLVLKKIPIPETPPQTPPQVLDSPHQRSPSLSLAPLSPRAPSEDVFAFDLSSNPSPGPSPAWTDSASLGPEPLPIPPEPPAILPAGVAGTPGLPESPDKSPVGRKKSKGLATRLSRRRVSCRELGRPDCDGWLLLRKAPGGFMGPRWRRRWFVLKGHTLYWYRQPQDEKAEGLINVSNYSLESGHDQKKKYVFQLTHDVYKPFIFAADTLTDLSMWVRHLITCISKYQSPGRAPPPREEDCYSETEAEDPDDEAGSHSASPSPAQAGSPLHGDTSPAATPTQRSPRTSFGSLTDSSEEALEGMVRGLRQGGVSLLGQPQPLTQEQWRSSFMRRNRDPQLNERVHRVRALQSTLKAKLQELQVLEEVLGDPELTGEKFRQWKEQNRELYSEGLGAWGVAQAEGSSHILTSDSTEQSPHSLPSDPEEHSHLCPLTSESSLRPPDL

SEQ ID NO: 9652 - protein, 720 aa, Artificial Sequence
  Description of Artificial Sequence: Synthetic coding sequence
MEPVETWTPGKVATWLRGLDDSLQDYPFEDWQLPGKNLLQLCPQSLEALAVRSLGHQELILGGVEQLQALSSRLQTENLQSLTEGLLGATHDFQSIVQGCLGDCAKTPIDVLCAAVELLHEADALLFWLSRYLFSHLNDFSACQEIRDLLEELSQVLHEDGPAAEKEGTVLRICSHVAGICHNILVCCPKELLEQKAVLEQVQLDSPLGLEIHTTSNCQHFVSQVDTQVPTDSRLQIQPGDEVVQINEQVVVREERDMVGWPRKNMVRELLREPAGLSLVLKKIPIPETPPQTPPQVLDSPHQRSPSLSLAPLSPRAPSEDVFAFDLSSNPSPGPSPAWTDSASLGPEPLPIPPEPPAILPAGVAGTPGLPESPDKSPVGRKKSKGLATRLSRRRVSCRELGRPDCDGWLLLRKAPGGFMGPRWRRRWFVLKGHTLYWYRQPQDEKAEGLINVSNYSLESGHDQKKKYVFQLTHDVYKPFIFAADTLTDLSMWVRHLITCISKYQSPGRAPPPREEDCYSETEAEDPDDEAGSHSASPSPAQAGSPLHGDTSPAATPTQRSPRTSFGSLTDSSEEALEGMVRGLRQGGVSLLGQPQPLTQEQWRSSFMRRNRDPQLNERVHRVRALQSTLKAKLQELQVLEEVLGDPELTGEKFRQWKEQNRELYSEGLGAWGVAQAEGSSHILTSDSTEQSPHSLPSDPEEHSHLCPLTSESSLRPPDL

SEQ ID NO: 9653 - protein, 311 aa, Artificial Sequence
  Description of Artificial Sequence: Synthetic coding sequence
MEPVETWTPGKVATWLRGLDDSLQDYPFEDWQLPGKNLLQLCPQSLEALAVRSLGHQELILGGVEQLQALSSRLQTENLQSLTEGLLGATHDFQSIVQGCLGDCAKTPIDVLCAAVELLHEADALLFWLSRYLFSHLNDFSACQEIRDLLEELSQVLHEDLQPRGWDLPQHPGLLPQGAAGTEGRARAGAAGQSIGPRNSHHHPHTCLQTPPNRHLPLLRPPSSLQTPPQVPAPAAPLPLLPPNLLSDPCLHCFVPGCSPDAPSGPGLPAPEEPITVSGPTVSQVTGSVQVCLGGETVGSSHPPCPPQGPI

SEQ ID NO: 9654 - protein, 1384 aa, Artificial Sequence
  Description of Artificial Sequence: Synthetic coding sequence
MMHLRLFCILLAAVSGAEGWGYYGCDEELVGPLYARSLGASSYYSLLTAPRFARLHGISGWSPRIGDPNPWLQIDLMKKHRIRAVATQGSFNSWDWVTRYMLLYGDRVDSWTPFYQRGHNSTFFGNVNESAVVRHDLHFHFTARYIRIVPLAWNPRGKIGLRLGLYGCPYKADILYFDGDDAISYRFPRGVSRSLWDVFAFSFKTEEKDGLLLHAEGAQGDYVTLELEGAHLLLHMSLGSSPIQPRPGHTTVSAGGVLNDQHWHYVRVDRFGRDVNFTLDGYVQRFILNGDFERLNLDTEMFIGGLVGAARKNLAYRHNFRGCIENVIFNRVNIADLAVRRHSRITFEGKVAFRCLDPVPHPINFGGPHNFVQVPGFPRRGRLAVSFRFRTWDLTGLLLFSRLGDGLGHVELTLSEGQVNVSIAQSGRKKLQFAAGYRLNDGFWHEVNFVAQENHAVISIDDVEGAEVRVSYPLLIRTGTSYFFGGCPKPASRWDCHSNQTAFHGCMELLKVDGQLVNLTLVEGRRLGFYAEVLFDTCGITDRCSPNMCEHDGRCYQSWDDFICYCELTGYKGETCHTPLYKESCEAYRLSGKTSGNFTIDPDGSGPLKPFVVYCDIRENRAWTVVRHDRLWTTRVTGSSMERPFLGAIQYWNASWEEVSALANASQHCEQWIEFSCYNSRLLNTAGGYPYSFWIGRNEEQHFYWGGSQPGIQRCACGLDRSCVDPALYCNCDADQPQWRTDKGLLTFVDHLPVTQVVIGDTNRSTSEAQFFLRPLRCYGDRNSWNTISFHTGAALRFPPIRANHSLDVSFYFRTSAPSGVFLENMGGPYCQWRRPYVRVELNTSRDVVFAFDVGNGDENLTVHSDDFEFNDDEWHLVRAEINVKQARLRVDHRPWVLRPMPLQTYIWMEYDQPLYVGSAELKRRPFVGCLRAMRLNGVTLNLEGRANASEGTSPNCTGHCAHPRLPCFHGGRCVERYSYYTCDCDLTAFDGPYCNHDIGGFFEPGTWMRYNLQSALRSAAREFSHMLSRPVPGYEPGYIPGYDTPGYVPGYHGPGYRLPDYPRPGRPVPGYRGPVYNVTGEEVSFSFSTSSAPAVLLYVSSFVRDYMAVLIKDDGTLQLRYQLGTSPYVYQLTTRPVTDGQPHSINITRVYRNLFIQVDYFPLTEQKFSLLVDSQLDSPKALYLGRVMETGVIDPEIQRYNTPGFSGCLSGVRFNNVAPLKTHFRTPRPMTAELAEALRVQGELSESNCGAMPRLVSEVPPELDPWYLPPDFPYYHDEGWVAILLGFLVAFLLLGLVGMLVLFYLQNHRYKGSYHTNEPKAAHEYHPGSKPPLPTSGPAQVPTPTAAPNQAPASAPAPAPTPAPAPGPRDQNLPQILEESRSE

SEQ ID NO: 9655 - protein, 380 aa, Artificial Sequence
  Description of Artificial Sequence: Synthetic coding sequence
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMELAHGLQDQNLKISLTVCHQTTQ

SEQ ID NO: 9656 - protein, 746 aa, Artificial Sequence
  Description of Artificial Sequence: Synthetic coding sequence
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEW

SEQ ID NO: 9657 - protein, 202 aa, Artificial Sequence
  Description of Artificial Sequence: Synthetic coding sequence
MTYHFQEHYTLSENSSSLVSSLYRDVTLTREMITLSFRTTRSPSLLLYVSSFYEEYLSVILANNGSLQIRYKLDRHQNPDAFTFDFKNMADGQLHQVKINREEAVVMVEVNQSAKKQVILSSGTEFNAVKSLILGKVLGRSGPVDEGEPLVNADRRDSAVMGGVIAVVIFILLCITAIAIRIYQQRKLRKENESKVSKKEEC

SEQ ID NO: 9658 - protein, 1176 aa, Artificial Sequence
  Description of Artificial Sequence: Synthetic coding sequence
  MOD_RES (1)..(1): Any amino acid
XGRELETGQGRQSSVGAAQGTGVRAGVRAGTTQSGRRRARVSGRLAEVSMASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLYRDVTLTREMITLSFRTTRSPSLLLYVSSFYEEYLSVILANNGSLQIRYKLDRHQNPDAFTFDFKNMADGQLHQVKINREEAVVMVEVIPQMQKSN

SEQ ID NO: 9659 - protein, 1288 aa, Artificial Sequence
  Description of Artificial Sequence: Synthetic coding sequence
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLYRDVTLTREMITLSFRTTRSPSLLLYVSSFYEEYLSVILANNGSLQIRYKLDRHQNPDAFTFDFKNMADGQLHQVKINREEAVVMVEVNQSAKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPVDEGEPLVNADRRDSAVMGGVIAVVIFILLCITAIAIRIYQQRKLRKENESKVSKKEEC

SEQ ID NO: 9660 - protein, 600 aa, Artificial Sequence
  Description of Artificial Sequence: Synthetic coding sequence
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGALYEQSCEAHKHRGNPSGLYYIDADGSGPLGPFLVYCNMTDSAWTVVRHGGPDAVTLRGAPSGHPLSAVSFAYAAGAGQLRAAVNLAERCEQRLALRCGTARRPDSRG

SEQ ID NO: 9661 - protein, 1306 aa, Artificial Sequence
  Description of Artificial Sequence: Synthetic coding sequence
MDSLPRLTSVLTLLFSGLWHLGLTATNYNCDDPLASLLSPMAFSSSSDLTGTHSPAQLNWRVGTGGWSPADSNAQQWLQMDLGNRVEITAVATQGRYGSSDWVTSYSLMFSDTGRNWKQYKQEDSIWTFAGNMNADSVVHHKLLHSVRARFVRFVPLEWNPSGKIGMRVEVYGCSYKSDVADFDGRSSLLYRFNQKLMSTLKDVISLKFKSMQGDGVLFHGEGQRGDHITLELQKGRLALHLNLGDSKARLSSSLPSATLGSLLDDQHWHSVLIERVGKQVNFTVDKHTQHFRTKGETDALDIDYELSFGGIPVPGKPGTFLKKNFHGCIENLYYNGVNIIDLAKRRKHQIYTGNVTFSCSEPQIVPITFVNSSGSYLLLPGTPQIDGLSVSFQFRTWNKDGLLLSTELSEGSGTLLLSLEGGILRLVIQKMTERVAEILTGSNLNDGLWHSVSINARRNRITLTLDDEAAPPAPDSTWVQIYSGNSYYFGGCPDNLTDSQCLNPIKAFQGCMRLIFIDNQPKDLISVQQGSLGNFSDLHIDLCSIKDRCLPNYCEHGGSCSQSWTTFYCNCSDTSYTGATCHNSIYEQSCEVYRHQGNTAGFFYIDSDGSGPLGPLQVYCNITEDKIWTSVQHNNTELTRVRGANPEKPYAMALDYGGSMEQLEAVIDGSEHCEQEVAYHCRRSRLLNTPDGTPFTWWIGRSNERHPYWGGSPPGVQQCECGLDESCLDIQHFCNCDADKDEWTNDTGFLSFKDHLPVTQIVITDTDRSNSEAAWRIGPLRCYGDRRFWNAVSFYTEASYLHFPTFHAEFSADISFFFKTTALSGVFLENLGIKDFIRLEISSPSEITFAIDVGNGPVELVVQSPSLLNDNQWHYVRAERNLKETSLQVDNLPRSTRETSEEGHFRLQLNSQLFVGGTSSRQKGFLGCIRSLHLNGQKMDLEERAKVTSGVRPGCPGHCSSYGSICHNGGKCVEKHNGYLCDCTNSPYEGPFCKKEVSAVFEAGTSVTYMFQEPYPVTKNISLSSSAIYTDSAPSKENIALSFVTTQAPSLLLFINSSSQDFVVVLLCKNGSLQVRYHLNKEETHVFTIDADNFANRRMHHLKINREGRELTIQMDQQLRLSYNFSPEVEFRVIRSLTLGKVTENLGLDSEVAKANAMGFAGCMSSVQYNHIAPLKAALRHATVAPVTVHGTLTESSCGFMVDSDVNAVTTVHSSSDPFGKTDEREPLTNAVRSDSAVIGGVIAVVIFIIFCIIGIMTRFLYQHKQSHRTSQMKEKEYPENLDSSFRNEIDLQNTVSECKREYFI

SEQ ID NO: 9662 - protein, 1042 aa, Artificial Sequence
  Description of Artificial Sequence: Synthetic coding sequence
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 9663 - protein, 975 aa, Artificial Sequence
  Description of Artificial Sequence: Synthetic coding sequence
MKQSPALAPEERCRRAGSPKPVLRADDNNMGNGCSQKLATANLLRFLLLVLIPCICALVLLLVILLSYVGACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 9664 - protein, 1005 aa, Artificial Sequence
  Description of Artificial Sequence: Synthetic coding sequence
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCACHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 9665 - protein, 144 aa, Artificial Sequence
  Description of Artificial Sequence: Synthetic coding sequence
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 9666 - protein, 96 aa, Artificial Sequence
  Description of Artificial Sequence: Synthetic coding sequence
MAFTFAAFCYMLALLLTAALIFFAIWHIIAFDELKTDYKNPIDQCNTLNPLVLPEYLIHAFFCVMFLCAAEWLTLGLNMPLLAYHIWSMIYVLVSS

SEQ ID NO: 9667 - protein, 160 aa, Artificial Sequence
  Description of Artificial Sequence: Synthetic coding sequence
MAFTFAAFCYMLTLVLCASLIFFVIWHIIAFDELRTDFKNPIDQGNPARARERLKNIERICCLLRKLVVPEYSIHGLFCLMFLCAAEWVTLGLNIPLLFYHLWRYFHRPADGSEVMYDAVSIMNADILNYCQKESWCKLAFYLLSFFYYLYSMVYTLVSF

SEQ ID NO: 9668 - protein, 160 aa, Artificial Sequence
  Description of Artificial Sequence: Synthetic coding sequence
MAFTFAAFCYMLSLVLCAALIFFAIWHIIAFDELRTDFKSPIDQCNPVHARERLRNIERICFLLRKLVLPEYSIHSLFCIMFLCAQEWLTLGLNVPLLFYHFWRYFHCPADSSELAYDPPVVMNADTLSYCQKEAWCKLAFYLLSFFYYLYCMIYTLVSS

SEQ ID NO: 9669 - protein, 137 aa, Artificial Sequence
  Description of Artificial Sequence: Synthetic coding sequence
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSGSNCPC

SEQ ID NO: 9670 - protein, 92 aa, Artificial Sequence
  Description of Artificial Sequence: Synthetic coding sequence
MEAVVFVFSLLDCCALIFLSVYFIITLSDLECDYINARSCCSKLNKWVIPELIGHTIVTVLLLMSLHWFIFLLNLPVATWNIYRMILALIND

SEQ ID NO: 9671 - protein, 90 aa, Artificial Sequence
  Description of Artificial Sequence: Synthetic coding sequence
MEAVVFVFSLLDCCALIFLSVYFIITLSDLECDYINARSCCSKLNKWVIPELIGHTIVTVLLLMSLHWFIFLLNLPVATWNIYRGSNCPC

SEQ ID NO: 9672 - protein, 139 aa, Artificial Sequence
  Description of Artificial Sequence: Synthetic coding sequence
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 9673 - protein, 81 aa, Artificial Sequence
  Description of Artificial Sequence: Synthetic coding sequence
MDGGQPIPSSLVPLGNESADSSMSLEQKMTFVFVILLFIFLGILIVRCFRILLDPYRSMPTSTWADGLEGLEKGQFDHALA

SEQ ID NO: 9674 - protein, 81 aa, Artificial Sequence; identical to SEQ ID NO: 9673
  Description of Artificial Sequence: Synthetic coding sequence

SEQ ID NO: 9675 - protein, 37 aa, Artificial Sequence
  Description of Artificial Sequence: Synthetic coding sequence
VYTDYIYFNSFLESFQGFFVSVFYCFLNSEVRSAIRK

SEQ ID NO: 9676 - protein, 240 aa, Artificial Sequence
  Description of Artificial Sequence: Synthetic coding sequence
MSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 9677 - protein, 401 aa, Artificial Sequence
  Description of Artificial Sequence: Synthetic coding sequence
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQVRSAIRKRWHRWQDKHSIRARVARAMSIPTSPTRVSFHSIKQSTAV

SEQ ID NO: 9678 - protein, 375 aa, Artificial Sequence
  Description of Artificial Sequence: Synthetic coding sequence
MGGHPQLRLVKALLLLGLNPVSASLQDQHCESLSLASNISDNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 9679 - protein, 125 aa, Artificial Sequence
  Description of Artificial Sequence: Synthetic coding sequence
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEEPGTQAQPGRAHRGGT

SEQ ID NO: 9680 - protein, 415 aa, Artificial Sequence
  Description of Artificial Sequence: Synthetic coding sequence
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 9681 - protein, 285 aa, Artificial Sequence
  Description of Artificial Sequence: Synthetic coding sequence
MVSATIPQKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRASLCLCSTVSSIVRSVLPSGRGGTGGRTSTRSVPEWPVPCPSPPPQPVSAFTASSSPQQSELAGHGAAPKQLWLGG

SEQ ID NO: 9682 - protein, 444 aa, Artificial Sequence
  Description of Artificial Sequence: Synthetic coding sequence
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRPGCTHWGDQADGALEVGAPWSGAPFQVRRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 9683 - protein, 106 aa, Artificial Sequence
  Description of Artificial Sequence: Synthetic coding sequence
MALDPADQHLRHVEKDVLIPKIMREKAKERCSEQVQDFTKCCKNSGVLMVVKCRKENSALKECLTAYYNDPAFYEECKMEYLKEREEFRKTGIPTKKRLQKLPTSM

SEQ ID NO: 9684 - protein, 106 aa, Artificial Sequence
  Description of Artificial Sequence: Synthetic coding sequence
MFAPAVMRAFRKNKTLGYGVPMLLLIVGGSFGLREFSQIRYDAVKSKMDPELEKKLKENKISLESEYEKIKDSKFDDWKNIRGPRPWEDPDLLQGRNPESLKTKTT

SEQ ID NO: 9685 - protein, 333 aa, Artificial Sequence
  Description of Artificial Sequence: Synthetic coding sequence
MLCRLGGRWLRPLPALQLWARDLPLAPVPTSGAKRPTLPVWAVAPVSAVHANGWYEALAASSPVRVAEEVLLGVHAATGLPWWGSILLSTVALRGAVTLPLAAYQHYILAKVENLQPEIKTIARHLNQEVAVRANQLGWSKRDARLTYLKNMRRLISELYVRDNCHPFKATVLVWIQLPMWIFMSFALRNLSTGAAHSEGFSVQEQLATGGILWFPDLTAPDSTWILPISVGVINLLIVEICALQKIGMSRFQTYITYFVRAMSVLMIPIAATVPSSIVLYWLCSSFVGLSQNLLLRSPGFRQLCRIPSTKSDSETPYKDIFAAFNTKFISRK

SEQ ID NO: 9686 - protein, 334 aa, Artificial Sequence
  Description of Artificial Sequence: Synthetic coding sequence
MLCRLGGRWLRPLPALQLWARDLPLAPVPTSGAKRPTLPVWAVAPVSAVHANGWYEALAASSPVRVAEEVLLGVHAATGLPWWGSILLSTVALRGAVTLPLAAYQHYILAKVENLQPEIKTIARHLNQEVAVRANQLGWSKRDARLTYLKNMRRLISELYVRDNCHPFKATVLVWIQLPMWIFMSFALRNLSTGAAHSEAGFSVQEQLATGGILWFPDLTAPDSTWILPISVGVINLLIVEICALQKIGMSRFQTYITYFVRAMSVLMIPIAATVPSSIVLYWLCSSFVGLSQNLLLRSPGFRQLCRIPSTKSDSETPYKDIFAAFNTKFISRK

SEQ ID NO: 9687 - protein, 777 aa, Artificial Sequence
  Description of Artificial Sequence: Synthetic coding sequence
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGEVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISRATEGLETYRKLAKDLEEELERTVHFYQKQVISYEKRGHDNWLAARTAERNLSDLRKENAHNKQKLTETELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGLIPPPLAPISGPLFPVDTRGPFMRRGPPFPPPPPGTMFGASRGYFPPRDFPGPPHAPFAMRNIYPPRGLPPYLHPRPGFYPNPTF

SEQ ID NO: 9688 - protein, 777 aa, Artificial Sequence
  Description of Artificial Sequence: Synthetic coding sequence
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISRATEGLETYRKLAKDLEEELERTVHFYQKQVISYEKRGHDNWLAARTAERNLSDLRKENAHNKQKLTETELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGFIPPPLAPVRGPLFPVDTRGPFMRRGPPFPPPPPGTMFGASRGYFPPRDFPGPPHAPFAMRNIYPPRGLPPYLHPRPGFYPNPTF

SEQ ID NO: 9689 - protein, 777 aa, Artificial Sequence
  Description of Artificial Sequence: Synthetic coding sequence
MEEPGATPQPYLGLVLEELGRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLSRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELKVNSQWENGANLDDPPKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISHATEELETYRKLAKDLEEELERTVHFYQKQVISYEKRGHDNWLAARTAERNLSDLRKENAHNKQKLTERELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGLIPPPLAPISGPLFPVDTRGPFMRRGPPFPPPPPGTMFGASRGYFPPRDFPGPPHAPFAMRNIYPPRGLPPYLHPRPGFYPNPTF

SEQ ID NO: 9690 - protein, 244 aa, Artificial Sequence
  Description of Artificial Sequence: Synthetic coding sequence
MMRTQCLLGLRTFVAFAAKLWSFFIYLLRRQIRTVIQYQTVRYDILPLSPVSRNRLAQVKRKILVLDLDETLIHSHHDGVLRPTVRPGTPPDFILKVVIDKHPVRFFVHKRPHVDFFLEVVSQWYELVVFTASMEIYGSAVADKLDNSRSILKRRYYRQHCTLELGSYIKDLSVVHSDLSSIVILDNSPGAYRSHPDNAIPIKSWFSDPSDTALLNLLPMLDALRFTADVRSVLSRNLHQHRLW

SEQ ID NO: 9691 - protein, 244 aa, Artificial Sequence; identical to SEQ ID NO: 9690
  Description of Artificial Sequence: Synthetic coding sequence

SEQ ID NO: 9692 - protein, 229 aa, Artificial Sequence
  Description of Artificial Sequence: Synthetic coding sequence
MQDEDGYITLNIKTRKPALISVGSASSSWWRVMALILLILCVGMVVGLVALGIWSVMQRNYLQGENENRTGTLQQLAKRFCQYVVKQSELKGTFKGHKCSPCDTNWRYYGDSCYGFFRHNLTWEESKQYCTDMNATLLKIDNRNIVEYIKARTHLIRWVGLSRQKSNEVWKWEDGSVISENMFEFLEDGKGNMNCAYFHNGKMHPTFCENKHYLMCERKAGMTKVDQLP

SEQ ID NO: 9693 - protein, 196 aa, Artificial Sequence
  Description of Artificial Sequence: Synthetic coding sequence
MQDEDGYITLNIKTRKPALISAVMQRNYLQGENENRTGTLQQLAKRFCQYVVKQSELKGTFKGHKCSPCDTNWRYYGDSCYGFFRHNLTWEESKQYCTDMNATLLKIDNRNIVEYIKARTHLIRWVGLSRQKSNEVWKWEDGSVISENMFEFLEDGKGNMNCAYFHNGKMHPTFCENKHYLMCERKAGMTKVDQLP

SEQ ID NO: 9694 - protein, 138 aa, Artificial Sequence
  Description of Artificial Sequence: Synthetic coding sequence
HKCSPCDTNWRYYGDSCYGFFRHNLTWEESKQYCTDMNATLLKIDSKEEKLFLTSFRILTIVFIWVGLSRQKSNEVWKWEDGSVISDSLFSQSNFQNGKGNMNCAYFHNGKMHPTFCENKHYLMCERKAGMTKVDQLP

SEQ ID NO: 9695 - protein, 196 aa, Artificial Sequence; identical to SEQ ID NO: 9693
  Description of Artificial Sequence: Synthetic coding sequence

SEQ ID NO: 9696 - protein, 276 aa, Artificial Sequence
  Description of Artificial Sequence: Synthetic coding sequence
MSEEVTYATLTFQDSAGARNNRDGNNLRKRGHPAPSPIWRHAALGLVTLCLMLLIGLVTLGMMFLQISNDINSDSEKLSQLQKTIQQQQDNLSQQLGNSNNLSMEEEFLKSQISSVLKRQEQMAIKLCQELIIHTSDHRCNPCPKMWQWYQNSCYYFTTNEEKTWANSRKDCIDKNSTLVKIDSLEEKDFLMSQPLLMFSFFWLGLSWDSSGRSWFWEDGSVPSPSLFSTKELDQINGSKGCAYFQKGNIYISRCSAEIFWICEKTAAPVKTEDLD

SEQ ID NO: 9697 - protein, 232 aa, Artificial Sequence
  Description of Artificial Sequence: Synthetic coding sequence
MSEEVTYATLTFQDSAGARNNRDGNNLRKRGHPAPSPIWRHAALGLVTLCLMLLIGLVTLGMMFLQISNDINSDSEKLSQLQKTIQQQQDNLSQQLGNSNNLSMEEEFLKSQISSVLKRQEQMAIKLCQELIIHTSDHRCNPCPKMWQWYQNSCYYFTTNEEKTWANSRKDCIDKNSTLVKIDSLEEKDFLMSQPLLMFSFFWLGLSWDSSGRSWFWEDGSVPSPSLYVSNY

SEQ ID NO: 9698 - protein, 490 aa, Artificial Sequence
  Description of Artificial Sequence: Synthetic coding sequence
MRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSAVVFIFVSTAVVVLVILTMTVLGLVKLCFHESPSSQPRKESMGPPGLESDPEPAALGSSSAHCTNNGVKVGDCDLRDRAEGALLAESPLGSSDA

SEQ ID NO: 9699 - protein, 210 aa, Artificial Sequence
  Description of Artificial Sequence: Synthetic coding sequence
GTNSRAMCCVPPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSAVVFIFVSTAVVVLVILTMTVLGLVKLCFHESPSSQPRKESMGPPGLES

SEQ ID NO: 9700 - protein, 289 aa, Artificial Sequence
  Description of Artificial Sequence: Synthetic coding sequence
MHNLYSITGYPDPPGTMEEEEEDDDYENSTPPYKDLPPKPGTMEEEEEDDDYENSTPPYKDLPPKPALTLSFSSPGSSAPPRPPRAAKETEKPPLPCKPRNMTGLDLAAVTCPPPQLAVNLEPSPLQPSLAATPVPWLNQRSGGPGCCQKRWMVYLCLLVVTSLFLGCLGLTVTLIKYQELMEELRMLSFQQMTWRTNMTGMAGLAGLKHDIARVRADTNQSLVELWGLLDCRRITCPEGWLPFEGKCYYFSPSTKSWDEARMFCQENYSHLVIINSFAEHLLGARGTQ

SEQ ID NO: 9701 - protein, 378 aa, Artificial Sequence
  Description of Artificial Sequence: Synthetic coding sequence
MHNLYSITGYPDPPGTMEEEEEDDDYENSTPPYKDLPPKPGTMEEEEEDDDYENSTPPYKDLPPKPGTMEEEEEDDDYENSTPPYKDLPPKPGSSAPPRPPRAAKETEKPPLPCKPRNMTGLDLAAVTCPPPQLAVNLEPSPLQPSLAATPVPWLNQRSGGPGCCQKRWMVYLCLLVVTSLFLGCLGLTVTLIKYQELMEELRMLSFQQMTWRTNMTGMAGLAGLKHDIARVRADTNQSLVELWGLLDCRRITCPEGWLPFEGKCYYFSPSTKSWDEARMFCQENYSHLVIINSFAEHNFVAKAHGSPRVYWLGLNDRAQEGDWRWLDGSPVTLSFWEPEEPNNIHDEDCATMNKGGTWNDLSCYKTTYWICERKCSC

SEQ ID NO: 9702 - protein, 306 aa, Artificial Sequence
  Description of Artificial Sequence: Synthetic coding sequence
MHNLYSITGYPDPPGTMEEEEEDDDYENSTPPYKDLPPKPGTMEEEEEDDDYENSTPPYKDLPPKPGTMEEEEEDDDYENSTPPYKDLPPKPGSSAPPRPPRAAKETEKPPLPCKPRNMTGLDLAAVTCPPPQLAVNLEPSPLQPSLAATPVPWLNQRSGGPGCCQKRWMVYLCLLVVTSLFLGCLGLTVTLIKYQELMEELRMLSFQQMTWRTNMTGMAGLAGLKHDIARVRADTNQSLVELWGLLDCRRITCPEGWLPFEGKCYYFSPSTKSWDEARMFCQENYSHLVIINSFAEHLLGARGTQ

SEQ ID NO: 9703 - protein, 589 aa, Artificial Sequence
  Description of Artificial Sequence: Synthetic coding sequence
MDGEAVRFCTDNQCVSLHPQEVDSVAMAPAAPKIPRLVQATPAFMAVTLVFSLVTLFVVVQQQTRPVPKPVQAVILGDNITGHLPFEPNNHHHFGREAEMRELIQTFKGHMENSSAWVVEIQMLKCRVDNVNSQLQVLGDHLGNTNADIQMVKGVLKDATTLSLQTQMLRSSLEGTNAEIQRLKEDLEKADALTFQTLNFLKSSLENTSIELHVLSRGLENANSEIQMLNASLETANTQAQLANSSLKNANAEIYVLRGHLDSVNDLRTQNQVLRNSLEGANAEIQGLKENLQNTNALNSQTQAFIKSSFDNTSAEIQFLRGHLERAGDEIHVLKRDLKMVTAQTQKANGRLDQTDTQIQVFKSEMENVNTLNAQIQVLNGHMKNASREIQTLKQGMKNASALTSQTQMLDSNLQKASAEIQRLRGDLENTKALTMEIQQEQSRLKTLHVVITSQEQLQRTQSQLLQMVLQGWKFNGGSLYYFSSVKKSWHEAEQFCVSQGAHLASVASKEEQAFLVEFTSKVYYWIGLTDRGTEGSWRWTDGTPFNAAQNKAPGSKGSCPLRKYIIVNSGMGACSFIDTPPCPWILSN

SEQ ID NO: 9704 - protein, 293 aa, Artificial Sequence
  Description of Artificial Sequence: Synthetic coding sequence
MDTTRYSKWGGSSEEVPGGPWGRWVHWSRRPLFLALAVLVTTVLWAVILSILLSKASTERAALLDGHDLLRTNASKQTAALGALKEEVGDCHSCCSGTQAQLQTTRAELGEAQAKLMEQESALRELRERVTQGLAEAGRGREDVRTELFRALEAVRLQNNSCEPCPTSWLSFEGSCYFFSVPKTTWAAAQDHCADASAHLVIVGGLDEQGFLTRNTRGRGYWLGLRAVRHLGKVQGYQWVDGVSLSFSHWNQGEPNDAWGRENCVMMLHTGLWNDAPCDSEKDGWICEKRHNC

SEQ ID NO: 9705 - protein, 252 aa, Artificial Sequence
  Description of Artificial Sequence: Synthetic coding sequence
MEQESALRELRERVTQGLAEAGRGREDVRTELFRALEAVRLQNNSCEPCPTSWLSFEGSCYFFSVPKTTWAAAQDHCADASAHLVIVGGLDEQGFLTRNTRGRGYWLGLRAVRHLGKVQGYQWVDGVSLSFSHWNQGEPNDAWGRENCVMMLHTGLWNDAPCDSEKDGWICEKAQLLTPPSALEPRPLQHVVSWGLLTSLAPGADCQRVFSSSSTAAESQKHLAQHSPVQPSAWALGPPCRPHPNSTHADPT

SEQ ID NO: 9706 - protein, 241 aa, Artificial Sequence
  Description of Artificial Sequence: Synthetic coding sequence
MHEEEIYTSLQWDSPAPDTYQKCLSSNKCSGACCLVMVISCVFCMGLLTASIFLGVKLLQVSTIAMQQQEKLIQQERALLNFTEWKRSCALQMKYCQAFMQNSLSSAHNSSPCPNNWIQNRESCYYVSEIWSIWHTSQENCLKEGSTLLQIESKEEMDFITGSLRKIKGSYDYWVGLSQDGHSGRWLWQDGSSPSPGLLPAERSQSANQVCGYVKSNSLLSSNCSTWKYFICEKYALRSSV

SEQ ID NO: 9707 - protein, 167 aa, Artificial Sequence
  Description of Artificial Sequence: Synthetic coding sequence
MVSNFFHVIQVFEKSATLISKTEHIGFVIYSWRKSTTHLGSRRKFAISIYLSEVSLQKYDCPFSGTSFVVFSLFLICAMAGDVVYADIKTVRTSPLELAFPLQRSVSFNFSTVHKSCPAKDWKVHKGKCYWIAETKKSWNKSQNDCAINNSYLMVIQDITAMVRFNI

SEQ ID NO: 9708 - protein, 35 aa, Artificial Sequence
  Description of Artificial Sequence: Synthetic coding sequence
QDITAMLITFLLYLQMAFLQCVYISDVSVYPNFFL

SEQ ID NO: 9709 - protein, 241 aa, Artificial Sequence
  Description of Artificial Sequence: Synthetic coding sequence
MGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 9710 - protein, 326 aa, Artificial Sequence
  Description of Artificial Sequence: Synthetic coding sequence
MRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 9711 - protein, 326 aa, Artificial Sequence; identical to SEQ ID NO: 9710
  Description of Artificial Sequence: Synthetic coding sequence

SEQ ID NO: 9712 - protein, 326 aa, Artificial Sequence; identical to SEQ ID NO: 9710
  Description of Artificial Sequence: Synthetic coding sequence

SEQ ID NO: 9713 - protein, 607 aa, Artificial Sequence
  Description of Artificial Sequence: Synthetic coding sequence
MELVRRLMPLTLLILSCLAELTMAEAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEIFLEIDKQCKFDFLAIYDGPSTNSGLIGQVCGRVTPTFESSSNSLTVVLSTDYANSYRGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 9714 - protein, 745 aa, Artificial Sequence
  Description of Artificial Sequence: Synthetic coding sequence
MRPDSHPYGFPWELVIRAAVAGFFAVLFLWRSFRSVTSRLYVRREKKFAVALSGLIEEKCKLLEKFSLVQKEYEGYEVESSLKNASFEKEATEAQSLEATCEKLNRFNSELVHEILCLEKELKEEKSKHSEQNELMADISKRIQSLEDESKSLKSQVAEAKMTFKRFQANEERLEIEIQDAWKENSELQESQKQLLQEAEVWKEQVSELIKQKRTFEDSKVHAEQVLNDKENHIKTLTERLLKMKDGVAMLEEDVTDDDNLELEMNSESEDGAYLDNPPKGALKKLIHAAKLNASLKTLEGERNQIYIQLSEVDKTKEELTEHIKNLQTEQASLQSENTHFESENQKLQQKLKVMTELYQENEMKLYRKLIVEEKCRLEKEEKLSKVDEMISHATEELETYRKRAKDLKEFEKTIHFYQKKIILHEKKAHDNWSAAWTAERNLNDLRKENAHNRQKLTEIEFKIKLLEKDPYGLDVPNTAFGRQHSPYGPSPLGWPSSETRASLYPPTLLEGPLRLSPLLPRGGGRGSRGPGNPPDHQITKERGESSCDRLTDPHRAPSDAGPLAPPWEQDYRMMFPPPGQSYPDSALPPQRQDRFYSNCARLSGPAELRSFNMPSLDKMDGSMPSEMESSRNDTKDNLGNLKVPDSSLPAENEATGPGFVPPPLAPIRGLLFPVDTRGPFIRRGPPFPPPPPGTVFGASPDYFSPRDVPGPPRAPFAMRNVYLPRGFLPYRPPRPAFFPPAPTF

SEQ ID NO: 9715 - protein, 74 aa, Artificial Sequence
  Description of Artificial Sequence: Synthetic coding sequence
MFVIISLHNCVVISFVLFLFGGNNFIQNFYLPQNYIDQFLLTSFPTFTSVGVLIVLVLCSAFLLLWQGEGVNLR

SEQ ID NO: 9716 - protein, 1505 aa, Artificial Sequence
  Description of Artificial Sequence: Synthetic coding sequence
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGSARRKGKDQPESRRPGSLPAPPPSQLPRNPGEQASNTNGTHQFSPAGLSQDFFSSSLASPSLPLASTGKFALNSLLQRQLMQSFYSKAMQEAGSTSMIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 9717 - protein, 678 aa, Artificial Sequence
  Description of Artificial Sequence: Synthetic coding sequence
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 9718 - protein, 1516 aa, Artificial Sequence
  Description of Artificial Sequence: Synthetic coding sequence
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGSARRKGKDQPESRRPGSLPAPPPSQLPRNPGEQASNTNGTHQFSPAGLSQDFFSSSLASPSLPLASTGKFALNSLLQRQLMQSFYSKAMQEAGSTSMIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 9719 - protein, 639 aa, Artificial Sequence
  Description of Artificial Sequence: Synthetic coding sequence
MAANVGSMFQYWKRFDLQQLQDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 9720 - protein, 632 aa, Artificial Sequence
  Description of Artificial Sequence: Synthetic coding sequence
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 9721 - protein, 676 aa, Artificial Sequence
  Description of Artificial Sequence: Synthetic coding sequence
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 9722 - protein, 1403 aa, Artificial Sequence
  Description of Artificial Sequence: Synthetic coding sequence
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRENPGQSLNRLFQEVPKRRNGSEGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 9723 - protein, 662 aa, Artificial Sequence
  Description of Artificial Sequence: Synthetic coding sequence
MAANVGSMFQYWKRFDLQQLQRELDATATVLANRQDESEQSRKRLIEQSREFKKNTPEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 9724 - protein, 1483 aa, Artificial Sequence
  Description of Artificial Sequence: Synthetic coding sequence
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGSARRKGKDQPESRRPGSLPAPPPSQLPRNPGEQASNTNGTHQFSPAGLSQDFFSSSLASPSLPLASTGKFALNSLLQRQLMQSFYSKAMQEAGSTSMIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRGNITTRIRASETGSDEAIKSILEQAKRELQVQKTAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 9725 - protein, 1449 aa, Artificial Sequence
  Description of Artificial Sequence: Synthetic coding sequence
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGSARRKGKDQPESRRPGSLPAPPPSQLPRNPGEQASNTNGTHQFSPAGLSQDFFSSSLASPSLPLASTGKFALNSLLQRQLMQSFYSKAMQEAGSTSMIFSTGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 9726 - protein, 1347 aa, Artificial Sequence
  Description of Artificial Sequence: Synthetic coding sequence
MLCVAGARLKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGPYSTNSISSQSPLQQSPDVNGMAPSPSQSESAGSVSEGEEMDTAEIARQVKEQLIKHNIGQRIFGHYVLGLSQGSVSEILARPKPWNKLTVRGKEPFHKMKQFLSDEQNILALRSIQGRQRAEPAQPSSASGSGNSDDAIRSILQQARREMEAQQAALDPALKQAPLSQSDITILTPKLLSTSPMPTVSSYPPLAISLKKPSAAPEAGASALPNPPALKKEAQDAPGLDPQGAADCAQGVLRQVKNEVGRSGAWKDHWWSAVQPERRNAASSEEAKAEETGGGKEKGSGGSGGGSQPRAERSQLQGPSSSEYWKEWPSAESPYSQSSELSLTGASRSETPQNSPLPSSPIVPMSKPTKPSVPPLTPEQYEVYMYQEVDTIELTRQVKEKLAKNGICQRIFGEKVLGLSQGSVSDMLSRPKPWSKLTQKGREPFIRMQLWLNGELGQGVLPVQGQQQGPVLHSVTSLQDPLQQGCVSSESTPKTSASCSPAPESPMSSSESVKSLTELVQQPCPPIEASKDSKPPEPSDPPASDSQPTTPLPLSGHSALSIQELVAMSPELDTYGITKRVKEVLTDNNLGQRLFGETILGLTQGSVSDLLARPKPWHKLSLKGREPFVRMQLWLNDPNNVEKLMDMKRMEKKAYMKRRHSSVSDSQPCEPPSVGTEYSQGASPQPQHQLKKPRVVLAPEEKEALKRAYQQKPYPSPKTIEDLATQLNLKTSTVINWFHNYRSRIRRELFIEEIQAGSQGQAGASDSPSARSGRAAPSSEGDSCDGVEATEGPGSADTEEPKSQGEAEREEVPRPAEQTEPPPSGTPGPDDARDDDHEGGPVEGPGPLPSPASATATAAPAAPEDAATSAAAAPGEGPAAPSSAPPPSNSSSSSAPRRPSSLQSLFGLPEAAGARDSRDNPLRKKKAANLNSIIHRLEKAASREEPIEWEF

SEQ ID NO: 9727 - protein, 633 aa, Artificial Sequence
  Description of Artificial Sequence: Synthetic coding sequence
MKISAWLMCARGKDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 9728 - protein, 692 aa, Artificial Sequence
  Description of Artificial Sequence: Synthetic coding sequence
MSAGTGKGGPQTPVESPTASSKLPQAHWLCSPGIKRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 9729 - protein, 572 aa, Artificial Sequence
  Description of Artificial Sequence: Synthetic coding sequence
MDRAGADMWASTFTLAMAERKPQDVWVLLPEHSLVPGCLDGGGVQYLLVGLSRLQCGHCPGTWDSAHVHVLFHLWWDRASHRGLVKMRIWGQRCRLCPAPGDCQVRPPGEQPFLSRLVLHILQDCYGDGPGPARHPREAYEGCCEACELGVCFLQKAPDPAWSANATKGNFPATAWGGTGTVSRGKPLSTPGDDLGKGGVVIAIPFSLVGTSNDQVPIAEGPAPPAGASLPVTGSCEALVIGQGSIFLSGDSVAMPGGKGFPVAIGDPLFHGPGLLGSSIQTFELKGFLFKGRGSLCSPVGVAQGWGPISLNNGLVPVGKHTPTVFYCVGLSASGEGSLTFPSSLTSIFTNTLSEPTDGPVATKEASITFPFIFTDVKDAVAEVAEGNGKEGGGQGLVPVGHDALPETNAGGLPSQVKGSLALPFPADVQGKDAFTDITEGKEKEGGLVTAGHDAPLEANAEGPITVSEGCITIPFAVFDVIKRKGGGHVAYGPQGNGCFSQGYYQKRQLRSRFHKARCGCRREEDERPGRACRRPHAEPYEDFWIWVSMTVCVFWLMCMCRLNPGIYPQQV

SEQ ID NO: 9730 - protein, 575 aa, Artificial Sequence
  Description of Artificial Sequence: Synthetic coding sequence
MSQDTKVKTTESSPPAPSKARKLLPVLDPSGDYYYWWLNTMVFPVMYNLIILVCRACFPDLQHGYLVAWLVLDYTSDLLYLLDMVVRFHTGFLEQGILVVDKGRISSRYVRTWSFFLDLASLMPTDVVYVRLGPHTPTLRLNRFLRAPRLFEAFDRTETRTAYPNAFRIAKLMLYIFVVIHWNSCLYFALSRYLGFGRDAWVYPDPAQPGFERLRRQYLYSFYFSTLILTTVGDTPPPAREEEYLFMVGDFLLAVMGFATIMGSMSSVIYNMNTADAAFYPDHALVKKYMKLQHVNRKLERRVIDWYQHLQINKKMTNEVAILQHLPERLRAEVAVSVHLSTLSRVQIFQNCEASLLEELVLKLQPQTYSPGEYVCRKGDIGQEMYIIREGQLAVVADDGITQYAVLGAGLYFGEISIINIKGNMSGNRRTANIKSLGYSDLFCLSKEDLREVLSEYPQAQTIMEEKGREILLKMNKLDVNAEAAEIALQEATESRLRGLDQQLDDLQTKFARLLAELESSALKIAYRIERLEWQTREWPMPEDLAEADDEGEPEEGTSKDEEGRASQEGPPGPE

SEQ ID NO: 9731 - protein, 387 aa, Artificial Sequence
  Description of Artificial Sequence: Synthetic coding sequence
MMDEPWWEGRVASDVHCTLREKELKLPTFRAHSPLLKSRRFFVDILTLLSSHCQLCPAARHLAVYLLDHFMDRYNVTTSKQLYTVAVSCLLLASKFEDREDHVPKLEQINSTRILSSQNFTLTKKELLSTELLLLEAFSWNLCLPTPAHFLDYYLLASVSQKDHHCHTWPTTCPRKTKECLKEYAHYFLEVTLQDHIFYKFQPSVVAAACVGASRICLQLSPYWTRDLQRISSYSLEHLSTCIEILLVVYDNVLKDAVAVKSQALAMVPGTPPTPTQVLFQPPAYPALGQPATTLAQFQTPVQDLCLAYRDSLQAHRSGSLLSGSTGSSLHTPYQPLQPLDMCPVPVPASLSMHMAIAAEPRHCLATTYGSSYFSGSHMFPTGCFDR

SEQ ID NO: 9732 - protein, 435 aa, Artificial Sequence
  Description of Artificial Sequence: Synthetic coding sequence
MMDEPWWEGRVASDVHCTLREKELKLPTFRAHSPLLKSRRFFVDILTLLSSHCQLCPAARHLAVYLLDHFMDRYNVTTSKQLYTVAVSCLLLANGVSLLSPRLKCSGMISAHCNLHLPGSSNSPASAPHPPPTPPQVAETTGKFEDREDHVPKLEQINSTRILSSQNFTLTKKELLSTELLLLEAFSWNLCLPTPAHFLDYYLLASVSQKDHHCHTWPTTCPRKTKECLKEYAHYFLEVTLQDHIFYKFQPSVVAAACVGASRICLQLSPYWTRDLQRISSYSLEHLSTCIEILLVVYDNVLKDAVAVKSQALAMVPGTPPTPTQVLFQPPAYPALGQPATTLAQFQTPVQDLCLAYRDSLQAHRSGSLLSGSTGSSLHTPYQPLQPLDMCPVPVPASLSMHMAIAAEPRHCLATTYGSSYFSGSHMFPTGCFDR

SEQ ID NO: 9733 - protein, 166 aa, Artificial Sequence
  Description of Artificial Sequence: Synthetic coding sequence
MRHTSKRKPQYYEAEMVLKYYKHLEEGSVSLCCPGWSAVAQSRLTAASTFGAQVILLFQLSEQLRLQELKLPTFRAHSPLLKSRRFFVDILTLLSSHCQLCPAARHLAVYLLDHFMDRYNVTTSKQLYTVAVSCLLLASRNKGSGSPVPTRSAQQCRQTWARGSPW

SEQ ID NO: 9734 - protein, 252 aa, Artificial Sequence
  Description of Artificial Sequence: Synthetic coding sequence
MMDEPWWEGRVASDVHCTLREKELKLPTFRAHSPLLKSRRFFVDILTLLSSHCQLCPAARHLAVYLLDHFMDRYNVTTSKQLYTVAVSCLLLASKFEDREDHVPKLEQINSTRILSSQNFTLTKKELLSTELLLLEAFSWNLCLPTPAHFLDYYLLASVSQKDHHCHTWPTTCPRKTKECLKEYAHYFLEVTLQDHIFYKFQPSVVAAACVGASRICLQLSPYWTRDLQRISSYSLEHLSTCIEILLVPLFR

SEQ ID NO: 9735 - protein, 251 aa, Artificial Sequence
  Description of Artificial Sequence: Synthetic coding sequence
MDEPWWEGRVASDVHCTLREKELKLPTFRAHSPLLKSRRFFVDILTLLSSHCQLCPAARHLAVYLLDHFMDRYNVTTSKQLYTVAVSCLLLASKFEDREDHVPKLEQINSTRILSSQNFTLTKKELLSTELLLLEAFSWNLCLPTPAHFLDYYLLASVSQKDHHCHTWPTTCPRKTKECLKEYAHYFLEVTLQDHIFYKFQPSVVAAACVGASRICLQLSPYWTRDLQRISSYSLEHLSTCIEILLVPLFR

SEQ ID NO: 9736 - protein, 410 aa, Artificial Sequence
  Description of Artificial Sequence: Synthetic coding sequence
MDLTGLLLDEEGTFSLAGFQDFTFLPGHQKLSARIRRRLYYGWDWEADCSLEELSSPVADIAVELLQKAAPSPIRRLQKKYVAHVSREACISPCAMMLALVYIERLRHRNPDYLQHVSSSDLFLISMMVASKYLYDEGEEEEVFNDEWGAAGGVAVPTLNALERGFLSAMDWHLYTDPREIFEVLSWLESCVAEQQGRWRGWYTYTDLCVLLEQPTWQLALGSLCQRLVKLSCLLAVAYVSSVALAVASVAVIHQSLGLSCIPTPGPPDLGLTSRCLLEPCIPSVPQCLPSLANVSSCLEGSMGLRSLWGSLLASLTPPPLPPPDPPAPPTLLHNCHLCQKLQRDSPTCHACLHPNRTVPTALSSPWYHTYGLAPPWPWSPVLLSLPQPQQCSLFSVMELARLKSFVFPG

SEQ ID NO: 9737 - protein, 410 aa, Artificial Sequence; identical to SEQ ID NO: 9736
  Description of Artificial Sequence: Synthetic coding sequence

SEQ ID NO: 9738 - protein, 308 aa, Artificial Sequence
  Description of Artificial Sequence: Synthetic coding sequence
MDLTGLLLDEEGTFSLAGFQDFTFLPGHQKLSARIRRRLYYGWDWEADCSLEELSSPVADIAVELLQKAAPSPIRRLQKKYVAHVSREACISPCAMMLALVYIERLRHRNPDYLQHVSSSDLFLISMMVASKYLYDEGEEEEVFNDEWGAAGGVAVPTLNALERGFLSAMDWHLYTDPREIFEVLSWLESCVAEQQGRWRGWYTYTDLCVLLEQPTWQLALGSLCQRLVKLSCLLAVAYVSSVALAVASVAVIHQSLGLSCIPTPGPPDLGLTSRCLLEPCIPSVPQCLPSLANVSSCLEGSMGLRSL

SEQ ID NO: 9739 - protein, 451 aa, Artificial Sequence
  Description of Artificial Sequence: Synthetic coding sequence
MHGYFGCNAAAEPGYSAFVGTPQICVTKMSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 9740 - protein, 469 aa, Artificial Sequence
  Description of Artificial Sequence: Synthetic coding sequence
MCDLIEPQPAEKIGKMKKLRRTLSESFSRIALKKDDTTFDEICVTKMSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 9741 - protein, 340 aa, Artificial Sequence
  Description of Artificial Sequence: Synthetic coding sequence
MLALTLRPPPLAKSHLKLGGTPAPARVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 9742 - protein, 450 aa, Artificial Sequence
  Description of Artificial Sequence: Synthetic coding sequence
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEVAVEPRADSALHPGGVRSWPWSRLPAPQDHSVHLFLCHLPGFTLQGLPMATVGPHHTLPLSPCEGWSRGRGHVPSQEYENIQSSRGDSWPVLGEPYLLCATDVPIRTVSSAASQGLHMQNDDACLGAAPECCLLVKEKCRE

SEQ ID NO: 9743 - protein, 346 aa, Artificial Sequence
  Description of Artificial Sequence: Synthetic coding sequence
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRWYRAPELLYGARQYDQGVDLWSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEESLLNPELIRPFILEG

SEQ ID NO: 9744 - protein, 338 aa, Artificial Sequence
  Description of Artificial Sequence: Synthetic coding sequence
MDQYCILGRIGEGAHGIVFKAKHVEPRVGWQCLPSILQTGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEESLLNPELIRPFILEG

SEQ ID NO: 9745 - protein, 243 aa, Artificial Sequence
  Description of Artificial Sequence: Synthetic coding sequence
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSSLSCRTTTRSPLRSRCPCPWRRCCLTSLPRHWICWVNSFSTLLTSASQLPRLSSISTSSQLPCLPIHLSCRFLSV

SEQ ID NO: 9746 - protein, 325 aa, Artificial Sequence
  Description of Artificial Sequence: Synthetic coding sequence
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEESLLNPELIRPFILEG

SEQ ID NO: 9747 - protein, 154 aa, Artificial Sequence
  Description of Artificial Sequence: Synthetic coding sequence
MDAPRLPVRPGVLLPKLVLLFVYADDCLAQCGKDCKSYCCDGTTPYCCSYYAYIGNILSGTAIAGIVFGIVFIMGVIAGIAICICMCMKNHRATRVGILRTTHINTVSSYPGPPPYGHDHEMEYCADLPPPYSPTPQGPAQRSPPPPYPGNARK

SEQ ID NO: 9748 - protein, 172 aa, Artificial Sequence
  Description of Artificial Sequence: Synthetic coding sequence
MKCEPGWPRTPEWPPSPRLSAVGRDKETWAPSAARLGPRAPQLRGVPQSLARDAPGPGSLGRLPRQWPGLCSTRLSGALLSPSDRPPSSPFPPVPGSPFAPSLRPPAWMDAPRLPVRPGVLLPKLVLLFVYADDCLAQCGKDCKSYCCDGTTPYCCSYYAYIGNILSCCCPR

SEQ ID NO: 9749 - protein, 224 aa, Artificial Sequence
  Description of Artificial Sequence: Synthetic coding sequence
MSILLPNMAEFDTISELEEEEEEEAATSSSSPSSSSSVSGPDDDEEDEEEEEEEEEEEEEEEEEEEEEAPPPPRVVSEEHLRRYAPDPVLVRGAGHITVFGLSNKFDTEFPSVLTGKVAPEEFKTSIGRVNACLKKALPVNVKWLLCGCLCCCCTLGCSLWPVICLNKRTRRSIQKLIEWENNRLYHKLALHWKLTKRKCETSNMMEYVILIEFLPKYPIFRPD

SEQ ID NO: 9750 - protein, 204 aa, Artificial Sequence
  Description of Artificial Sequence: Synthetic coding sequence
MSILLPNMAEFDTISELEEEEEEEAATSSSSPSSSSSVSGPDDDEEDEEEEEEEEEEEEEEEEEEEEEAPPPPRVVSEEHLRRYAPDPVLVRGAGHITVFGLSNKFDTEFPSVLTGKVAPEEFKTSIGRVNACLKKALPVNVKWLLCGCLCCCCTLGCSLWPVICLNKRTRRSIQKLIEWENNRLYHKVILIEFLPKYPIFRPD

SEQ ID NO: 9751 - protein, 446 aa, Artificial Sequence
  Description of Artificial Sequence: Synthetic coding sequence
MHEPSLCANVECPPAHTCPCGVPACSCAHVECPPAHTCRCGVPACSHMPMWSARLLTRAHVECPPAHTRVHVECPPAHVPMWSAHLLTCADVECHLLTHVPMWSARLLTCPCGVPACSHVPMRSARLLTRAHAECPPAHTCPCGVPACSHVPMRSARLLTRADVECPPAHTCPCGVPACSHVPTWSARLITRAHVECSPAHTCRCGVPACSHVPMWSVRLLTRADAECPPAHTCRCGVPACSHVPMWSARLLTCRCGVPACSHVPMWSARLLTCRCGVPACSHVPMWSARLLTRAHVECPPAHTCRRGVPACSRAHMECPPAHTCHCGVPACSHTCRCGVPACSHVPMWSARLLTRAHVECPPAHTRAHVECPPAHTCPCGVPACSHTCPCGVPACSHKALAWWFCRFPVLPAESDAVTVHSTHGGFLIRFYVKDPFYISLHLEIT

SEQ ID NO: 9752 - protein, 388 aa, Artificial Sequence
  Description of Artificial Sequence: Synthetic coding sequence
ANVECPPAHTCPCGVPACSCAHVECPPAHTCRCGVPACSHMPMWSARLLTRAHVECPPAHTRVHVECPPAHVPMWSAHLLTCADVECHLLTHVPMWSARLLTRADAECPPAHTCPCGVPACSHVPMRSARLLTRAHAECPPAHTCRRGVPACSHVPMWSARLLTRADAECPPAHTCRCGVPACSHVPMWSARLLTCRCGVPACSHVPMWSARLLTCRCGVPACSHVPMWSARLLTRAHVECPPAHTCRRGVPACSRAHMECPPAHTCHCGVPACSHTCRCGVPACSHVPMWSARLLTRAHVECPPAHTRAHVECPPAHTCPCGVPACSHTCPCGVPACSHKALAWWFCRFPVLPAESDAVTVHSTHGGFLIRFYVKDPFYISLHLEIT

SEQ ID NO: 9753 - protein, 286 aa, Artificial Sequence
  Description of Artificial Sequence: Synthetic coding sequence
MAMEGYWRFLALLGSALLVGFLSVIFALVWVLHYREGLGWDGSALEFNWHPVLMVTGFVFIQGIAIIVYRLPWTWKCSKLLMKSIHAGLNAVAAILAIISVVAVFENHNVNNIANMYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGALIFWIVTRPQWKRPKEPNSTILHPNGGTEQGARGSMPAYSGNNMDKSDSELNSEVAARKRNLALDEAGQRSTM

SEQ ID NO: 9754 - protein, 157 aa, Artificial Sequence
  Description of Artificial Sequence: Synthetic coding sequence
MAMEGYWRFLALLGSALLVGFLSVIFALVWVLHYREGLGWDGSALEFNWHPVLMVTGFVFIQGIASFRFFSLSASMGSAFSPSISHAHTCLFWNCHLWNSDCNSTYGIDRETDFFPERSCIQYIPARRCFRKYAWPSDPGVRGPHFLDSHQTAMETS

SEQ ID NO: 9755 - protein, 228 aa, Artificial Sequence
  Description of Artificial Sequence: Synthetic coding sequence
MLDEGEAIIVYRLPWTWKCSKLLMKSIHAGLNAVAAILAIISVVAVFENHNVNNIANMYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGALIFWIVTRPQWKRPKEPNSTILHPNGGTEQGARGSMPAYSGNNMDKSDSELNSEVAARKRNLALDEAGQRSTM

SEQ ID NO: 9756 - protein, 242 aa, Artificial Sequence
  Description of Artificial Sequence: Synthetic coding sequence
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 9757 - protein, 259 aa, Artificial Sequence
  Description of Artificial Sequence: Synthetic coding sequence
MGKNFSDSFLSRECVIRMVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 9758 - protein, 242 aa, Artificial Sequence; identical to SEQ ID NO: 9756
  Description of Artificial Sequence: Synthetic coding sequence

SEQ ID NO: 9759 - protein, 182 aa, Artificial Sequence
  Description of Artificial Sequence: Synthetic coding sequence
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFS

SEQ ID NO: 9760 - protein, 28 aa, Artificial Sequence
  Description of Artificial Sequence: Synthetic coding sequence
MVSGRFYLSCLLLGSLGSMCILFTIYWM

SEQ ID NO: 9761 - protein, 115 aa, Artificial Sequence
  Description of Artificial Sequence: Synthetic coding sequence
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYS

SEQ ID NO: 9762 - protein, 200 aa, Artificial Sequence
  Description of Artificial Sequence: Synthetic coding sequence
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFA

SEQ ID NO: 9763 - protein, 55 aa, Artificial Sequence
  Description of Artificial Sequence: Synthetic coding sequence
MVSGRFYLSCLLLGSLGSMCILFTIYWMQYWRGGFAWNGSIYMFNWHPVLMVAGM

SEQ ID NO: 9764 - protein, 305 aa, Artificial Sequence
  Description of Artificial Sequence: Synthetic coding sequence
MGIQTSPVLLASLGVGLVTLLGLAVGSYLVRRSRRPQVTLLDPNEKYLLRLLDKTTVSHNTKRFRFALPTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSQKMRFTY

SEQ ID NO: 9765 - protein, 226 aa, Artificial Sequence
  Description of Artificial Sequence: Synthetic coding sequence
  MOD_RES (1)..(1): Any amino acid
XTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKGILPISGHPTIPSSSKSKPCPFVNSGFIEINLASHCQLGSLSAQTQ

SEQ ID NO: 9766 - protein, 133 aa, Artificial Sequence
  Description of Artificial Sequence: Synthetic coding sequence
MQPLEVGLVPAPAGEPRLTRWLRRGSGILAHLVALGFTIFLTALSRPGTKTGPLMEDRSEGGRARWVMPEIPALWEADAGGSLEVFSPGTLYSWPWRSASAWLKPSYSSHLNTPCSSSAPEKHGSGSTGQGRP

SEQ ID NO: 9767 - protein, 251 aa, Artificial Sequence
  Description of Artificial Sequence: Synthetic coding sequence
MQPLEVGLVPAPAGEPRLTRWLRRGSGILAHLVALGFTIFLTALSRPGTKTGPLMEDRSEGGRARWVMPEIPALWEADAGGSLEFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWFQAQIKGAAWYLCLALPVYPALVIMHQISRSYLPRKKMEM

SEQ ID NO: 9768 - protein, 172 aa, Artificial Sequence
  Description of Artificial Sequence: Synthetic coding sequence
MQPLEFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWFQAQIKGAAWYLCLALPVYPALVIMHQISRSYLPRKKMEM

SEQ ID NO: 9769 - protein, 229 aa, Artificial Sequence
  Description of Artificial Sequence: Synthetic coding sequence
MQPLEVGLVPAPAGEPRLTRWLRRGSGILAHLVALGFTIFLTALSRPGTSLFSWHPVFMALAFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWFQAQIKGAAWYLCLALPVYPALVIMHQISRSYLPRKKMEM

SEQ ID NO: 9770 - protein, 128 aa, Artificial Sequence
  Description of Artificial Sequence: Synthetic coding sequence
MQPLEVGLVPAPAGEPRLTRWLRRGSGILAHLVALGFTIFLTALSRPGTKTGPLMEDRSEGGRARWVMPEIPALWEADAGGSLEVFSPGTLYSWPWRMYESTSFFSGLQARHEAYWLSPMFTVLPLHG

SEQ ID NO: 9771 - protein, 74 aa, Artificial Sequence
  Description of Artificial Sequence: Synthetic coding sequence
MPKYYEDKPQGGACAGLKEDLGACLLQSDCVVQEGKSPRQCLKEGYCNSLKYAFFECKRSVLDNRARFRGRKGY

SEQ ID NO: 9772 - protein, 109 aa, Artificial Sequence
  Description of Artificial Sequence: Synthetic coding sequence
MAAVGVFSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 9773 - protein, 97 aa, Artificial Sequence
  Description of Artificial Sequence: Synthetic coding sequence
MALPLRPLTRGLASAAKGGHGGAGARTWRLLTFVLALPSVALCTFNSYLHSGHRPRPEFRPYQHLRIRTKPYPWGDGNHTLFHNSHVNPLPTGYEHP

SEQ ID NO: 9774 - protein, 88 aa, Artificial Sequence
  Description of Artificial Sequence: Synthetic coding sequence
MLDVEAQEPPKGKWSTPPFDPRFPSQNQIRNCYQNFLDYHRCLKTRTRRGKSTQPCEYYFRVYHSLCPISWVESWNEQIKNGIFAGKI

SEQ ID NO: 9775 - protein, 80 aa, Artificial Sequence
  Description of Artificial Sequence: Synthetic coding sequence
MFPLVKSALNRLQVRSIQQTMARQSHQKRTPDFHDKYGNAVLASGATFCIVTWTYVATQVGIEWNLSPVGRVTPKEWRNQ

SEQ ID NO: 9776 - protein, 69 aa, Artificial Sequence
  Description of Artificial Sequence: Synthetic coding sequence
MSVLTPLLLRGLTGSARRLPVPRAKIHSLPPEGKLGIMELAVGLTSCFVTFLLPAGWILSHLETYRRPE

SEQ ID NO: 9777 - protein, 72 aa, Artificial Sequence
  Description of Artificial Sequence: Synthetic coding sequence
MPLLRGRCPARRHYRRLALLGLQPAPRFAHSGPPRQRPLSAAEMAVGLVVFFTTFLTPAAYVLGNLKQFRRN

SEQ ID NO: 9778 - protein, 363 aa, Artificial Sequence
  Description of Artificial Sequence: Synthetic coding sequence
MAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 9779 - protein, 521 aa, Artificial Sequence
  Description of Artificial Sequence: Synthetic coding sequence
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 9780 - protein, 363 aa, Artificial Sequence; identical to SEQ ID NO: 9778
  Description of Artificial Sequence: Synthetic coding sequence

SEQ ID NO: 9781 - protein, 414 aa, Artificial Sequence
  Description of Artificial Sequence: Synthetic coding sequence
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRHWCKWPSMLWAESPPSSSTRKILTQPDG

SEQ ID NO: 9782 - protein, 286 aa, Artificial Sequence
  Description of Artificial Sequence: Synthetic coding sequence
MPSTRCSTPASPCSTFPQTCSVCSGPRPKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 9783 - protein, 144 aa, Artificial Sequence
  Description of Artificial Sequence: Synthetic coding sequence
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLNHH

SEQ ID NO: 9784 - protein, 490 aa, Artificial Sequence
  Description of Artificial Sequence: Synthetic coding sequence
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 9785 - protein, 431 aa, Artificial Sequence
  Description of Artificial Sequence: Synthetic coding sequence
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 9786 - protein, 490 aa, Artificial Sequence
  Description of Artificial Sequence: Synthetic coding sequence
MALLLLLFLGLLGLWGLLCACAQDPSPAARWPPGPRPLPLVGNLHLLRLSQQDRSLMELSERYGPVFTVHLGRQKTVVLTGFEAVKEALAGPGQELADRPPIAIFQLIQRGGGIFFSSGARWRAARQFTVRALHSLGVGREPVADKILQELKCLSGQLDGYRGRPFPLALLGWAPSNITFALLFGRRFDYRDPVFVSLLGLIDEVMVLLGSPGLQLFNVYPWLGALLQLHRPVLRKIEEVRAILRTLLEARRPHVCPGDPVCSYVDALIQQGQGDDPEGLFAEANAVACTLDMVMAGTETTSATLQWAALLMGRHPDVQGRVQEELDRVLGPGRTPRLEDQQALPYTSAVLHEVQRFITLLPHVPRCTAADTQLGGFLLPKGTPVIPLLTSVLLDETQWQTPGQFNPGHFLDANGHFVKREAFLPFSAGRRVCVGERLARTELFLLFAGLLQRYRLLPPPGVSPASLDTTPARAFTMRPRAQALCAVPRP

SEQ ID NO: 9787 - protein, 462 aa, Artificial Sequence
  Description of Artificial Sequence: Synthetic coding sequence
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTVWSEIGKGFLDGSLDKNMTRKKQYEDALMQLESVLRNIIKERKGRNFSQHIFIDSLVQGNLNDQQILEDSMIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 9788 - protein, 435 aa, Artificial Sequence
  Description of Artificial Sequence: Synthetic coding sequence
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTPSCNWSLFKEHHKRTKRKELQSTYFIDSLVQGNLNDQQILEDSMIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 9789 - protein, 512 aa, Artificial Sequence
  Description of Artificial Sequence: Synthetic coding sequence
MLFEGLDLVSALATLAACLVSVTLLLAVSQQLWQLRWAATRDKSCKLPIPKGSMGFPLIGETGHWLLQGSGFQSSRREKYGNVFKTHLLGRPLIRVTGAENVRKILMGEHHLVSTEWPRSTRMLLGPNTVSNSIGDIHRNKRKVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 9790 - protein, 437 aa, Artificial Sequence
  Description of Artificial Sequence: Synthetic coding sequence
MLFEGLDLVSALATLAACLVSVTLLLAVSQQLWQLRWAATRDKSCKLPIPKGSMGFPLIGETGHWLLQVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 9791 - protein, 455 aa, Artificial Sequence
  Description of Artificial Sequence: Synthetic coding sequence
MSVSVLSPSRRLGGVSGILQVTSLLILLLLLIKAAQLYLHRQWLLKALQQFPCPPSHWLFGHIQEFQHDQELQRIQERVKTFPSACPYWIWGGKVRVQLYDPDYMKVILGRSDPKSHGSYKFLAPRIGYGLLLLNGQTWFQHRRMLTPAFHNDILKPYVGLMADSVRVMLDKWEELLGQDSPLEVFQHVSLMTLDTIMKSAFSHQGSIQVDRNSQSYIQAISDLNSLVFCCMRNAFHENDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHGLLGDGASITWNHLDQMPYTTMCIKEALRLYPPVPGIGRELSTPVTFPDGRSLPKGIMVLLSIYGLHHNPKVWPNLEVFDPSRFAPGSAQHSHAFLPFSGGSR

SEQ ID NO: 9792 - protein, 421 aa, Artificial Sequence
  Description of Artificial Sequence: Synthetic coding sequence
MSVSVLSPSRRLGGVSGILQVTSLLILLLLLIKAAQLYLHRQWLLKALQQFPCPPSHWLFGHIQEFQHDQELQRIQERVKTFPSACPYWIWGGKVRVQLYDPDYMKVILGRSDPKSHGSYKFLAPRIGYGLLLLNGQTWFQHRRMLTPAFHNDILKPYVGLMADSVRVMLDKWEELLGQDSPLEVFQHVSLMTLDTIMKSAFSHQGSIQVDRPSDPTEEGSTTEGGGAGEDQEEEALGFSGHPPLGQRAPGLPRPCWCSGWNCFRNHLDQMPYTTMCIKEALRLYPPVPGIGRELSTPVTFPDGRSLPKGIMVLLSIYGLHHNPKVWPNLEVFDPSRFAPGSAQHSHAFLPFSGGSRNCIGKQFAMNQLKVARALTLLRFELLPDPTRIPIPMARLVLKSKNGIHLRLRRLPNPCEDKDQL

SEQ ID NO: 9793 - protein, 519 aa, Artificial Sequence
  Description of Artificial Sequence: Synthetic coding sequence
MSVSVLSPSRRLGGVSGILQVTSLLILLLLLIKAAQLYLHRQWLLKALQQFPCPPSHWLFGHIQEFQHDQELQRIQERVKTFPSACPYWIWGGKVRVQLYDPDYMKVILGRSDPKSHGSYKFLAPRIGYGLLLLNGQTWFQHRRMLTPAFHNDILKPYVGLMADSVRVMLDKWEELLGQDSPLEVFQHVSLMTLDTIMKSAFSHQGSIQVDRNSQSYIQAISDLNSLVFCCMRNAFHENDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHGLLGDGASITWNHLDQMPYTTMCIKEALRLYPPVPGIGRELSTPVTFPDGRSLPKGIMVLLSIYGLHHNPKVWPNLEVFDPSRFAPGSAQHSHAFLPFSGGSRNCIGKQFAMNQLKVARALTLLRFELLPDPTRIPIPMARLVLKSKNGIHLRLRRLPNPCEDKDQL

SEQ ID NO: 9794 - protein, 511 aa, Artificial Sequence
  Description of Artificial Sequence: Synthetic coding sequence
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGDPKAPDVYDFFLQWIGRGLLVLEGPKWLQHRKLLTPGFHYDVLKPYVAVFTESTRIMLDKWEEKAREGKSFDIFCDVGHMALNTLMKCTFGRGDTGLGHRDSSYYLAVSDLTLLMQQRLVSFQYHNDFIYWLTPHGRRFLRACQVAHDHTDQVIRERKAALQDEKVRKKIQNRRHLDFLDILLGARDEDDIKLSDADLRAEVDTFMFEGHDTTTSGISWFLYCMALYPEHQHRCREEVREILGDQDFFQWDDLGKMTYLTMCIKESFRLYPPVPQVYRQLSKPVTFVDGRSLPAGSLISMHIYALHRNSAVWPDPEVFDSLRFSTENASKRHPFAFMPFSAGPRNCIGQQFAMSEMKVVTAMCLLRFEFSLDPSRLPIKMPQLVLRSKNGFHLHLKPLGPGSGK

SEQ ID NO: 9795 - protein, 497 aa, Artificial Sequence
  Description of Artificial Sequence: Synthetic coding sequence
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGGRGLLVLEGPKWLQHRKLLTPGFHYDVLKPYVAVFTESTRIMLDKWEEKAREGKSFDIFCDVGHMALNTLMKCTFGRGDTGLGHSRDSSYYLAVSDLTLLMQQRLVSFQYHNDFIYWLTPHGRRFLRACQVAHDHTDQVIRERKAALQDEKVRKKIQNRRHLDFLDILLGARDEDDIKLSDADLRAEVDTFMFEGHDTTTSGISWFLYCMALYPEHQHRCREEVREILGDQDFFQWDDLGKMTYLTMCIKESFRLYPPVPQVYRQLSKPVTFVDGRSLPAGSLISMHIYALHRNSAVWPDPEVFDSLRFSTENASKRHPFAFMPFSAGPRNCIGQQFAMSEMKVVTAMCLLRFEFSLDPSRLPIKMPQLVLRSKNGFHLHLKPLGPGSGK

SEQ ID NO: 9796 - protein, 512 aa, Artificial Sequence
  Description of Artificial Sequence: Synthetic coding sequence
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGDPKAPDVYDFFLQWIGRGLLVLEGPKWLQHRKLLTPGFHYDVLKPYVAVFTESTRIMLDKWEEKAREGKSFDIFCDVGHMALNTLMKCTFGRGDTGLGHSRDSSYYLAVSDLTLLMQQRLVSFQYHNDFIYWLTPHGRRFLRACQVAHDHTDQVIRERKAALQDEKVRKKIQNRRHLDFLDILLGARDEDDIKLSDADLRAEVDTFMFEGHDTTTSGISWFLYCMALYPEHQHRCREEVREILGDQDFFQWDDLGKMTYLTMCIKESFRLYPPVPQVYRQLSKPVTFVDGRSLPAGSLISMHIYALHRNSAVWPDPEVFDSLRFSTENASKRHPFAFMPFSAGPRNCIGQQFAMSEMKVVTAMCLLRFEFSLDPSRLPIKMPQLVLRSKNGFHLHLKPLGPGSGK

SEQ ID NO: 9797 - protein, 190 aa, Artificial Sequence
  Description of Artificial Sequence: Synthetic coding sequence
MLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKAMTPRPVVSPGSCTTLQSTQNTRSAAGRRCKNF

SEQ ID NO: 9798 - protein, 520 aa, Artificial Sequence
  Description of Artificial Sequence: Synthetic coding sequence
MSQLSLSWLGLWPVAASPWLLLLLVGASWLLAHVLAWTYAFYDNCRRLRCFPQPPRRNWFWGHQGMVNPTEEGMRVLTQLVATYPQGFKVWMGPISPLLSLCHPDIIRSVINASAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 9799 - protein, 371 aa, Artificial Sequence
  Description of Artificial Sequence: Synthetic coding sequence
MLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 9800 - protein, 509 aa, Artificial Sequence
  Description of Artificial Sequence: Synthetic coding sequence
MEFSWLETRWARPFYLAFVFCLALGLLQAIKLYLRRQRLLRDLRPFPAPPTHWFLGHQKFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 9801 - protein, 508 aa, Artificial Sequence
  Description of Artificial Sequence: Synthetic coding sequence
MMWGGGLDLCPMPGQLKFPPCLSRCLLWEPPSLYLTQPTSSLAEPQALICMTSSSSGLFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 9802 - protein, 505 aa, Artificial Sequence
  Description of Artificial Sequence: Synthetic coding sequence
MEPSWLQELMAHPFLLLILLCMSLLLFQVIRLYQRRRWMIRALHLFPAPPAHWFYGHKEFYPVKEFEVYHKLMEKYPCAVPLWVGPFTMFFSVHDPDYAKILLKRQDPKSAVSHKILESWVGRGLVTLDGSKWKKHRQIVKPGFNISILKIFITMMSESVRMMLNKWEEHIAQNSRLELFQHVSLMTLDSIMKCAFSHQGSIQLDSTLDSYLKAVFNLSKISNQRMNNFLHHNDLVFKFSSQGQIFSKFNQELHQFTEKVIQDRKESLKDKLKQDTTQKRRWDFLDILLSAKSENTKDFSEADLQAEVKTFMFAGHDTTSSAISWILYCLAKYPEHQQRCRDEIRELLGDGSSITWEHLSQMPYTTMCIKECLRLYAPVVNISRLLDKPITFPDGRSLPAGITVFINIWALHHNPYFWEDPQVFNPLRFSRENSEKIHPYAFIPFSAGLRNCIGQHFAIIECKVAVALTLLRFKLAPDHSRPPQPVRQVVLKSKNGIHVFAKKVC

SEQ ID NO: 9803 - protein, 602 aa, Artificial Sequence
  Description of Artificial Sequence: Synthetic coding sequence
MPSAKQRGSKGGHGAASPSEKGAHPSGGADDVAKKPPPAPQQPPPPPAPHPQQHPQQHPQNQAHGKGGHRGGGGGGGKSSSSSSASAAAAAAAASSSASCSRRLGRALNFLFYLALVAAAAFSGWCVHHVLEEVQQVRRSHQDFSRQREELGQGLQGVEQKVQSLQATFGTFESILRSSQHKQDLTEKAVKQGESEVSRISEVLQKLQNEILKDLSDGIHVVKDARERDFTSLENTVEERLTELTKSINDNIAIFTEVQKRSQKEINDMKAKVASLEESEGNKQDLKALKEAVKEIQTSAKSREWDMEALRSTLQTMESDIYTEVRELVSLKQEQQAFKEAADTERLALQALTEKLLRSEESVSRLPEEIRRLEEELRQLKSDSHGPKEDGGFRHSEAFEALQQKSQGLDSRLQHVEDGVLSMQVASARQTESLESLLSKSQEHEQRLAALQGRLEGLGSSEADQDGLASTVRSLGETQLVLYGDVEELKRSVGELPSTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 9804 - protein, 3298 aa, Artificial Sequence
  Description of Artificial Sequence: Synthetic coding sequence
MQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPLGPSGGPAHELELEARDGGSPPRTSHFRLRVVVQDVGTRGLAPRFNSPTYRVDLPSGTTAGTQVLQVQAQAPDGGPITYHLAAEGASSPFGLEPQSGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGRANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGAVAASLGVVVVLALAALVLGLVRARSRKAEAAPGPMSQAAPLASDSLQKLGREPPSPPPSEHLYHQTLPSYGGPGAGGPYPRGGSLDPSHSSGRGSAEAAEDDEIRMINEFPRVASVASSLAARGPDSGIQQDADGLSDTSCEPPAPDTWYKGRKAGLLLPGAGATLYREEGPPATATAFLGGCGLSPAPTGDYGFPADGKPCVAGALTAIVAGEEELRGSYNWDYLLSWCPQFQPLASVFTEIARLKDEARPCPPAPRIDPPPLITAVAHPGAKSVPPKPANTAAARAIFPPASHRSPISHEGSLSSAAMSPSFSPSLSPLAARSPVVSPFGVAQGPSASALSAESGLEPPDDTELHI

SEQ ID NO: 9805 - protein, 153 aa, Artificial Sequence
  Description of Artificial Sequence: Synthetic coding sequence
MKAPCPQLPCPPASHPLCLLWLLAHPLSHHLGWPRVPQPQHSAQSLAWSHLMTRSCTSSCGPGWAPTWDAHSVPNAGPTLSLPWAASDYDWLRGGHHQAPALHPELPSPLRVLGPQKPCCSLTCDQVQCGEKYEGGSSPGFSSVRDPCPAPAP

SEQ ID NO: 9806 - protein, 706 aa, Artificial Sequence
  Description of Artificial Sequence: Synthetic coding sequence
MDIKHHQNGTRGQRRKQPHTTVQRLLTWGLPVSCSWFLWRQPGEFPVTALLLGAGAGGLLAIGLFQLLVNPMNIYEEQKIMFLYSLVGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHASFSYMDSYNHDIRFDNIYISTYFCQIDDRRKKLGKRTLLPLRKAEEKTVIFPCKPTIQASEMSNVVRELLETLPILLLLVVLCGLDWALYSIFDTIRHHSFLQYSFRSSHKLEVKVGGDSMLARLLRKTIGALNTSSETVMESNNMPCLPQPVGLDARAYWRAAVPIGLLVCLCLLQAFGYRLRRVIAAFYFPKREKKRILFLYNDLLKKRAAFTKLRRAAILRRERQQKAPRHPLADILHRGCPLLRRWLCRRCVVCQAPETPESYVCRTLDCEAVYCWSCWDDMRQRCPVCTPREELSSSAFSDSNDDTAYAG

SEQ ID NO: 9807 - protein, 664 aa, Artificial Sequence
  Description of Artificial Sequence: Synthetic coding sequence
MDIKHHQNGTRGQRRKQPHTTVQRLLTWGLPVSCSWFLWRQPGEFPVTALLLGAGAGGLLAIGLFQLLVNPMNIYEEQKIMFLYSLVGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHASFSYMDSYNHDIRFDNIYISTYFCQIDDRRKKLGKRTLLPLRKAEEKTVIFPCKPTIQASEMSNVVRELLETLPILLLLVVLCGLDWALYSIFDTIRHHSFLQYSFRSSHKLEVKVGGDSMLARLLRKTIGALNTSSETVMESNNMPCLPQPVGLDARAYWRAAVPIGLLVCLCLLQAFGYRLRRVIAAFYFPKREKKRILFLYNDLLKKRAAFTKLRRAAILRRERQQKAPVFTEPQFLPLKNGKTGEICKACSLEISLEWWSGVGLRCQRA

SEQ ID NO: 9808 - protein, 664 aa, Artificial Sequence; identical to SEQ ID NO: 9807
  Description of Artificial Sequence: Synthetic coding sequence

SEQ ID NO: 9809 - protein, 681 aa, Artificial Sequence
  Description of Artificial Sequence: Synthetic coding sequence
MDIKHHQNGTRGQRRKQPHTTVQRLLTWGLPVSCSWFLWRQPGEFPVTALLLGAGAGGLLAIGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHASFSYMDSYNHDIRFDNIYISTYFCQIDDRRKKLGKRTLLPLRKAEEKTVIFPCKPTIQASEMSNVVRELLETLPILLLLVVLCGLDWALYSIFDTIRHHSFLQYSFRSSHKLEVKVGGDSMLARLLRKTIGALNTSSETVMESNNMPCLPQPVGLDARAYWRAAVPIGLLVCLCLLQAFGYRLRRVIAAFYFPKREKKRILFLYNDLLKKRAAFTKLRRAAILRRERQQKAPRHPLADILHRGCPLLRRWLCRRCVVCQAPETPESYVCRTLDCEAVYCWSCWDDMRQRCPVCTPREELSSSAFSDSNDDTAYAG

SEQ ID NO: 9810 - protein, 639 aa, Artificial Sequence
  Description of Artificial Sequence: Synthetic coding sequence
MPKVMKDVVHPLGGEEPSMARAVVRSVGGFTLGLSLATAYGLLELLVEGHSPWGCLVGTLTLAAFLSLGMGFSRQVRATVLLLLPQAFSRQGRTLLLVAAFGLVLQGPCANTLRNFTRASEAVACGAELALNQTAEVLQRAKQPLVSALNKIKAIARKTKEVADRVRKFFRSIMDGVKHIARALRNVWQWLLHIGDVCNSELGNPYLKCARVFDDAKDSCMMVIPQAYHLCYVLMPFKLALCGLASLVQVFCVIPKYIQPFLRQTIGTPVIQLLNRVRQEFEFNMTATHHFSVDLNASRSLSQVAMDLHEAVSMKLHRVREALALMGFTTPLLLVLLYLQALFYRYCYLNWDHYDNIYITSRFLRMEAVRSTAGLPTVLPLSAHEARRYIPPGSIFLSQWEKFFYILETFNLIRHLLLVLFLVFLDYAVFWVLDLARHQLQGEIVARSPVLVSLTVEGTGYAGNIYRDLVSAFDVLQQGNISILSRRCLLRPSEPDSTGYIVIGVMYGLCFFITLFGSYVSRLRRVICASYYPSREQERISYLYNVLLSRRTNLLAALHRSVRRRAADQGHRSAFLVLASRCPCLGPFVSHFWLHQAYCLGCGQPQDEGDMENTVSCSTPGCQGFICKWHCSSSLVCTP

SEQ ID NO: 9811 - protein, 773 aa, Artificial Sequence
  Description of Artificial Sequence: Synthetic coding sequence
MPKVMKDVVHPLGGEEPSMARAVVRSVGGFTLGLSLATAYGLLELLVEGHSPWGCLVGTLTLAAFLSLGMGFSRQVRATVLLLLPQAFSRQGRTLLLVAAFGLVLQGPCANTLRNFTRASEAVACGAELALNQTAEVLQRAKQPLVSALNKIKAIARKTKEVADRVRKFFRSIMDGVKHIARALRNVWQWLLHIGDVCNSELGNPYLKCARVFDDAKDSCMMVIPQAYHLCYVLMPFKLALCGLASLVQVFCVIPKYIQPFLRQTIGTPVIQLLNRVRQEFEFNMTATHHFSVDLNASRSLSQVAMDLHEAVSMKLHRVREALALMGFTTPLLLVLLYLQALFYRYCYLNWDHYDNIYITSRFLRMEAVRSTAGLPTVLPLSAHEARRYIPPGSIFLSQWEKFFYILETFNLIRHLLLVLFLVFLDYAVFWVLDLARHQLQGEIVARSPVLVSLTVEGTGYAGNIYRDLVSAFDVLQQGNISILSRRCLLRPSEPDSTGYIVIGVMYGLCFFITLFGSYVSRLRRVICASYYPSREQERISYLYNVLLSRRTNLLAALHRSVRRRAADQGHRSAFLVLASRCPCLGPFVSHFWLHQAYCLGCGQPQDEGDMENTVSCSTPGCQGLYCLTCFRLLDNTCSVCASPLSYQGDLDLELDSSDEEGPQLWLAAAQRKDPEQAWLLQQQLQEVLGRSLSMESTSESSDLDEEKGPQQRKHGQQPLPEAHQPVSILTSPEPHRPPETSSATKGAPTPASEPSVPLSPPSLPDPSHPPPK

SEQ ID NO: 9812 - protein, 520 aa, Artificial Sequence
  Description of Artificial Sequence: Synthetic coding sequence
MGPTRKPNVCSRLSRRALGCFSRDAGVVQRTNLGILRALVCQESTKFKNVWTTHSRSPIAYERGRIYFDNYRRCVSSVASEPRKLYEMPKCSKSEKIEDALLWECPVGDILPNSSDYKSSLIALTAHNWLLRISATTGKILEKIYLAPYCKFRYLSWDTPQEVIAVKSAQNRGSAVARQAGIQQHVLLYLAVFRVLPFSLVGILEINKKIFGNVTDATLSHGILIVMYSSGLVRLYSFQTIAEQFMQQKLDLGCACRWGGTTGTVGEAPFGIPCNIKITDMPPLLFEVSSLENAFQIGGHPWHYIVTPNKKKQKGVFHICALKDNSLAKNGIQEMDCCSLESDWIYFHPDASGRIIHVGPNQVKVLKLTEIENNSSQHQISEDFVILANRENHKNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 9813 - protein, 270 aa, Artificial Sequence
  Description of Artificial Sequence: Synthetic coding sequence
RHSTTCFAVPCSVPSSTFFTCRDSRDQQKDMPPLLFEVSSLENAFQIGGHPWHYIVTPNKKKQKGVFHICALKDNSLAKNGIQEMDCCSLESDWIYFHPDASGRIIHVGPNQVKVLKLTEIENNSSQHQISEDFVILANRENHKNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 9814 - protein, 453 aa, Artificial Sequence
  Description of Artificial Sequence: Synthetic coding sequence
MGPTRKPNVCSRLSRRALGCFSRDAGVVQRTNLGILRALVCQESTKFKNVWTTHSRSPIAYERGRIYFDNYRRCVSSVASEPRKLYEMPKCSKSEKIEDALLWECPVGDILPNSSDYKSSLIALTAHNWLLRISATTGKILEKIYLAPYCKFRYLSWDTPQEVIAVKSAQNRGSAVARQAGIQQHVLLYLAVFRVLPFSLVGILEINKKIFGNVTDATLSHGILIVMYSSGLVRLYSFQTIAEQFMQQKLDLGCACRWGGTTGTVGEAPFGIPCNIKITDMPPLLFEVSSLENAFQIGGHPWHYIVTPNKKKQKGVFHICALKDNSLNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 9815 - protein, 314 aa, Artificial Sequence
  Description of Artificial Sequence: Synthetic coding sequence
MVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQDTINRIQDLLAEGTITGVIDDRGKFIYITPEELAAVANFIRQRGRVSIAELAQASNSLIAWGRESPAQAPA

SEQ ID NO: 9816 - protein, 298 aa, Artificial Sequence
  Description of Artificial Sequence: Synthetic coding sequence
MVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQVSPGTWPAVCSVARGLWLAERTCPKDRVLMHRLPCPQPRVSSAQKSPGTLGILHF

SEQ ID NO: 9817 - protein, 313 aa, Artificial Sequence
  Description of Artificial Sequence: Synthetic coding sequence
MVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQVSPGTWPAVCSVARGLWLAERTCPKDRVLMHRLPCPQPRVSSAQKSPGTLGILHFSLIAWGRESPAQAPA

SEQ ID NO: 9818 - protein, 107 aa, Artificial Sequence
  Description of Artificial Sequence: Synthetic coding sequence
MANEVQDLLSPRKGGHPPAVKAGGMRISKKQEIGTLERHTKKTGFEKTSAIANVAKIQTLDALNDALEKLNYKFPATVHMAHQKPTPALEKVVPLKRIYIIQQPRKC

SEQ ID NO: 9819 - protein, 919 aa, Artificial Sequence
  Description of Artificial Sequence: Synthetic coding sequence
MASATAAAARRGLGRALPLFWRGYQTERGVYGYRPRKPESREPQGALERPPVDHGLARLVTVYCEHGHKAAKINPLFTGQALLENVPEIQALVQTLQGPFHTAGLLNMGKEEASLEEVLVYLNQIYCGQISIETSQLQSQDEKDWFAKRFEELQKETFTTEERKHLSKLMLESQEFDHFLATKFSTVKRYGGEGAESMMGFFHELLKMSAYSGITDVIIGMPHRGRLNLLTGLLQFPPELMFRKMRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTTPAERGRSSLYCSDIGKLVGCAIIHVNGDSPEEVVRATRLAFEYQRQFRKDVIIDLLCYRQWGHNELDEPFYTNPIMYKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAIVVCQETDDTYIPLNHMDPNQKGFLEVSNSPLSEEAVLGFEYGMSIESPKLLPLWEAQFGDFFNGAQIIFDTFISGGEAKWLLQSGIVILLPHGYDGAGPDHSSCRIERFLQMCDSAEEGVDGDTVNMFVVHPTTPAQYFHLLRRQMVRNFRKPLIVASPKMLLRLPAAVSTLQEMAPGTTFNPVIGDSSVDPKKVKTLVFCSGKHFYSLVKQRESLGAKKHDFAIIRVEELCPFPLDSLQQEMSKYKHVKDHIWSQEEPQNMGPWSFVSPRFEKQLACKLRLVGRPPLPVPAVGIGTVHLHQHEDILAKTFA

SEQ ID NO: 9820 - protein, 161 aa, Artificial Sequence [sequence omitted]

SEQ ID NO: 9821 - protein, 308 aa, Artificial Sequence
  Description of Artificial Sequence: Synthetic coding sequence
MASATAAAARRGLGRALPLFWRGYQTERGVYGYRPRKPESREPQGALERPPVDHGLARLVTVYCEHGHKAAKINPLFTGQALLENVPEIQALVQTLQGPFHTAGLLNMGKEEASLEEVLVYLNQIYCGQISIETSQLQSQDEKDWFAKRFEELQKETFTTEERKHLSKLMLESQLMFRKMRGLSEFPENFSATGDVLSHLTSSVDLYFGAHHPLHVTMLPNPSHLEAVNPVAVGKTRGRQQSRQDGDYSPDNSAQPGDRVICLQVHGDASFCGQGIVPETFTLSNLPHFRIGGSVHLIVNNQLGYTTP

SEQ ID NO: 9822 - protein, 214 aa, Artificial Sequence
  Description of Artificial Sequence: Synthetic coding sequence
  MOD_RES (1)..(1): Any amino acid
XKIIRARKSIPDTYAEHLIAGGLMTQEEVSEIKSSYYAKLNDHLNNMAHYRPPALNLQAHWQGLAQPEAQITTWSTGVPLDLLRFVGMKSVEVPRELQMHSHLLKTHVQSRMEKMMDGIKLDWATAEALALGSLLAQGFNVRLSGQDVGRGTFSQRHAIVVCQETDDTYIPLNHMDPNQKGFLEERPSGSYKAASSSSFHMATMGLGQTTHPVE

SEQ ID NO: 9823 - protein, 313 aa, Artificial Sequence
  Description of Artificial Sequence: Synthetic coding sequence
MAAPMNGQVCVVTGASRGIGRGIALQLCKAGATVYITGRHLDTLRVVAQEAQSLGGQCVPVVCDSSQESEVRSLFEQVDREQQGRLDVLVNNAYAGVQTILNTRNKAFWETPASMWDDINNVGLRGHYFCSVYGARLMVPAGQGLIVVISSPGSLQYMFNVPYGVGKAACDKLAADCAHELRRHGVSCVSLWPGIVQTELLKEHMAKEEVLQDPVLKQFKSAFSSAETTELSGKCVVALATDPNILSLSGKVLPSCDLARRYGLRDVDGRPVQDYLSLSSVLSHVSGLGWLASYLPSFLRVPKWIIALYTSKF

SEQ ID NO: 9824 - protein, 313 aa, Artificial Sequence; identical to SEQ ID NO: 9823
  Description of Artificial Sequence: Synthetic coding sequence

SEQ ID NO: 9825 - protein, 325 aa, Artificial Sequence
  Description of Artificial Sequence: Synthetic coding sequence
FISGSSRKSLPKVKAMDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAAAEILQCFGYVDILVNNAGISYRGTIMDTTVDVDKRVMETNYFGPVALTKALLPSMIKRRQGHIVAISSIQGKMSIPFRSAYAASKHATQAFFDCLRAEMEQYEIEVTVISPGYIHTNLSVNAITADGSRYGVMDTTTAQGRSPVEVAQDVLAAVGKKKKDVILADLLPSLAVYLRTLAPGLFFSLMASRARKERKSKNS

SEQ ID NO: 9826 - protein, 325 aa, Artificial Sequence
  Description of Artificial Sequence: Synthetic coding sequence
MVSPATRKSLPKVKAMDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAAAEILQCFGYVDILVNNAGISYRGTIMDTTVDVDKRVMETNYFGPVALTKALLPSMIKRRQGHIVAISSIQGKMSIPFRSAYAASKHATQAFFDCLRAEMEQYEIEVTVISPGYIHTNLSVNAITADGSRYGVMDTTTAQGRSPVEVAQDVLAAVGKKKKDVILADLLPSLAVYLRTLAPGLFFSLMASRARKERKSKNS

SEQ ID NO: 9827 - protein, 1528 aa, Artificial Sequence
  Description of Artificial Sequence: Synthetic coding sequence
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVQNEFLDTPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAEIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 9828 - protein, 498 aa, Artificial Sequence
  Description of Artificial Sequence: Synthetic coding sequence
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVQNEFLDTPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAAVKSVKLEVDEDKSTKGSNFSNSEVAIGLSPYTFPQKRLFHVAGEENIT

SEQ ID NO: 9829 - protein, 1091 aa, Artificial Sequence
  Description of Artificial Sequence: Synthetic coding sequence
MCRKKPDTMILTQIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 9830 - protein, 323 aa, Artificial Sequence
  Description of Artificial Sequence: Synthetic coding sequence
MGSRVSREDFEWVYTDQPHADRRREILAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLVRKIAAEYYDNLPHYNSWIKVLYDFVMDDTISPYSRMKRHQKGEMVLE

SEQ ID NO: 9831 - protein, 323 aa, Artificial Sequence; identical to SEQ ID NO: 9830
  Description of Artificial Sequence: Synthetic coding sequence

SEQ ID NO: 9832 - protein, 261 aa, Artificial Sequence
  Description of Artificial Sequence: Synthetic coding sequence
MVSPQLAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLVRKIAAE

SEQ ID NO: 9833 - protein, 383 aa, Artificial Sequence
  Description of Artificial Sequence: Synthetic coding sequence
MPSGCRCLHLVCLLCILGAPGQPVRADDCSSHCDLAHGCCAPDGSCRCDPGWEGLHCERCVRMPGCQHGTCHQPWQCICHSGWAGKFCDKDEHICTTQSPCQNGGQCMYDGGGEYHCVCLPGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 9834 - protein, 377 aa, Artificial Sequence
  Description of Artificial Sequence: Synthetic coding sequence
MPSGCRCLHLVCLLCILGAPGQPVRADDCSSHCDLAHGCCAPDGSCRCDPGWEGLHCERCVRMPGCQHGTCHQPWQCICHSGWADEHICTTQSPCQNGGQCMYDGGGEYHCVCLPGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 9835 - protein, 383 aa, Artificial Sequence; identical to SEQ ID NO: 9833
  Description of Artificial Sequence: Synthetic coding sequence

SEQ ID NO: 9836 - protein, 134 aa, Artificial Sequence
  Description of Artificial Sequence: Synthetic coding sequence
MPSGCRCLHLVCLLCILGAPGQPVRADDCSSHCDLAHGCCAPDGSCRCDPGWEGLHCERCVRMPGCQHGTCHQPWQCICHSGWAGKFCDKDEHICTTQSPCQNGGQCMYDGGGEYHCVCLPGFHGRDCERKAGP

SEQ ID NO: 9837 - protein, 377 aa, Artificial Sequence; identical to SEQ ID NO: 9834
  Description of Artificial Sequence: Synthetic coding sequence

SEQ ID NO: 9838 - protein, 289 aa, Artificial Sequence
  Description of Artificial Sequence: Synthetic coding sequence
  MOD_RES (1)..(1): Any amino acid
XGCQHGTCHQPWQCICHSGWAGKFCDKGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 9839 - protein, 1146 aa, Artificial Sequence
  Description of Artificial Sequence: Synthetic coding sequence
MRKTDVDPLDEVCYRVVMQLCGLWGHPVLAVRVLFEMKTARIKPNAITYGYYNKVVLESPWPSSTRSGIFLWTKVRNVVRGLAQFRQPLKKTVQRSQVSSISALQNVTGGSDGDTVSHGSVDSSNDANNGEHTVFVRDLIRLESIDNHSSTGGQSDQGYGSKDELIKDDAEIHVPEEQAARELITKTKMQTEEVCDASAIVAKHSQPSPEPHSPTEPPAWGSSIVKVPSGIFDVNSRKSSISNVLFSTQDPVEDAVFGEATNLKKNGDRGEKRQKHFPERSCSFSSESRAGMLLKKSSLDSNSSEMAIMMGADAKILTAALTCPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIEAFDNEYGIAYNSLSSEILERLQKIDAPPSASVEWCRKCFGAPLI

SEQ ID NO: 9840 - protein, 670 aa, Artificial Sequence
  Description of Artificial Sequence: Synthetic coding sequence
MNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIEAFDNEYGIAYNSLSSEILERLQKIDAPPSASVEWCRKCFGAPLI

SEQ ID NO: 9841 - protein, 258 aa, Artificial Sequence
  Description of Artificial Sequence: Synthetic coding sequence
MKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPRYQRVQRPLYVVINGVPL

SEQ ID NO: 9842 - protein, 791 aa, Artificial Sequence
  Description of Artificial Sequence: Synthetic coding sequence
MLLKKSSLDSNSSEMAIMMGADAKILTAALTCPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRGI

SEQ ID NO: 9843 - protein, 1146 aa, Artificial Sequence; identical to SEQ ID NO: 9839
  Description of Artificial Sequence: Synthetic coding sequence

SEQ ID NO: 9844 - protein, 1673 aa, Artificial Sequence
  Description of Artificial Sequence: Synthetic coding sequence
MGATIECWDPETKYPLPVFSTFVLTGSSAKKVYGAAIQFYEPYSRELLSEKQLMHLGLLTPVERKMVSKSINTNKCICLLSHWPFFEAFRKFLMFIYKLSVSGPHPLPIEKHISHFMQNIPFPSPQRPRILVQLSVHDALILSQPVSTPLPLSGANFSTLLMNLGPENCATLLLFVLLESKILLHSLRPAVLTGVAEAVVAMIFPFQWQCPYIPLCPLSLAAVLSAPLPFIVGVDSRYFDLHDPPQDVVCIDLDTNMLYVSDEKKNMNWKQLPKKPCKNLLSTLKKLYPQLSSVHQKTQEGSAIDMTPIEADFSWQKKMTQLEMEIQEAFLRFMASILKGYRTYLRPITEAPSNKATAADSLFDRQGFLKSRDRAYAKFYTLLSKTQIFIRFIEECSFVSDKDTGLAFFDDCIEKLFPDKGTEKTDKVDFDSAEDTRLIELDDSQKSEHTVFIMPPEPPPDDGKDLSPKYSYKYFPRLDLKLFDRPQELKLCFSRHPTGNSITKSPPLMAKRTKQEIKTAHKLAKRCYTNPPQWAKCLFSHCYSLWFICLPAYVRVSHPKVRALQQAYDVLIKMRKTDVDPLDEVCYRVVMQLCGLWGHPVLAVRVLFEMKTARIKPNAITYGYYNKVVLESPWPSSTRSGIFLWTKVRNVVRGLAQFRQPLKKTVQRSQVSSISGGQSDQGYGSKDELIKDDAEIHVPEEQAARELITKTKMQTEEVCDASAIVAKHSQPSPEPHSPTEPPAWGSSIVKVPSGIFDVNSRKSSTGSISNVLFSTQDPVEDAVFGEATNLKKNGDRGEKRQKHFPERSCSFSSESRAGMLLKKSSLDSNSSEMAIMMGADAKILTAALTCPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIEAFDNEYGIAYNSLSSEILERLQKIDAPPSASVEWCRKCFGAPLI

SEQ ID NO: 9845 - protein, 791 aa, Artificial Sequence
  Description of Artificial Sequence: Synthetic coding sequence
MLLKKSSLDSNSSEMAIMMGADAKILTAALTCPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRNI

SEQ ID NO: 9846 - protein, 1003 aa, Artificial Sequence
  Description of Artificial Sequence: Synthetic coding sequence
MLTTSGGQSDQGYGSKDELIKDDAEIHVPEEQAARELITKTKMQTEEVCDASAIVAKHSQPSPEPHSPTEPPAWGSSIVKVPSGIFDVNSRKSSTGSISNVLFSTQDPVEDAVFGEATNLKKNGDRGEKRQKHFPERSCSFSSESRAGMLLKKSSLDSNSSEMAIMMGADAKILTAALTCPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIEAFDNEYGIAYNSLSSEILERLQKIDAPPSASVEWCRKCFGAPLI

SEQ ID NO: 9847 - protein, 1287 aa, Artificial Sequence
  Description of Artificial Sequence: Synthetic coding sequence
MSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 9848 - protein, 630 aa, Artificial Sequence
  Description of Artificial Sequence: Synthetic coding sequence
MKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 9849 - protein, 1241 aa, Artificial Sequence
  Description of Artificial Sequence: Synthetic coding sequence
MSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDEITSYTTGLPCWLTAPSLHTCMRMWH

SEQ ID NO: 9850 - protein, 1309 aa, Artificial Sequence
  Description of Artificial Sequence: Synthetic coding sequence
MGTHHHAQLIFVFLVEMRFHHVDQAGLELLTSSNSPASASRSAEITVVSQHAQPGFLYQWLEADRHGKSQGAANTTSGENFDQSPLRRTFKSKVLAHYPQNIEWNPFDQDAVNMLCMPKGLSFRTQTDNKDPQFHSFIITREDGSRTYGFVLTFYEEVTSKQICTAMQTLYQMHNAEHYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQDYQRLMTVAEGITTLLFPFQWQHVYVPILPASLLHFLDAPVPYLMGLQSKEGTDRSKLELPQEANLCFVDIDNHFIELPEEFPQFPNKVDFIQELSEVLVQFGIPPEGSLHCSESTSKLKNMVLKDLVNDKKNGNVCTNNISMYELLKGNETIARLQALAKRTGVAVEKMDLSASLGEKDKDLKLHCEEAELRDYQLNVQLREVFANRFTQMFADYEAFVIQTAQDMESWLTNREQMQNFDKASFLSDQPEPYLPFLSRFIETQMFATFIDNKIMSQWEEKDPLLRVFDTRIDKIRLYNVRAPTLRTSIYQKCSTLKEAAQSIEQRLMKMDHTAIHPHLLDMKIGQGKYEQGFFPKLQSDVLATGPTSNNRWVSRSATAQRRKERLRQHSEHVGLDNDLREKYMQEARSLGKNLRQPKLSDLSPAVIAQTNCKFVEGLLKECRMKTKRMLVEKMGHEAVELGHGEANITGLEENTLIASLCDLLERIWSHGLQVKQGKSALWSHLIQFQDREEKQEHLAESPVALGPERRKSDSGVMLPTLRVSLIQDMRHIQNMSEIKTDVGRARAWIRLSLEKKLLSQHLKQLLSNQPLTKKLYKRYAFLRCEEEREQFLYHLLSLNAVDYFCFTSVFTTIMIPYRSVIIPIKKLSNAIITSNPWICVSGELGDTGVMQIPKNLLEMTFECQNLGKLTTVQIGHDNSGLLAKWLVDCVMVRNEITGHTYRFPCGRWLGKGIDDGSLERILIGELMTSASDEDLVKQCRTPPQQKSPTTARRLSITSLTGKNNKPNAGQIQEGIGEAVNNIVKHFHKPEKERGSLTVLLCGENGLVAALEQVFHHGFKSARIFHKNVFIWDFIEKVVAYFETTDQILDNEDDVLIQKSSCKTFCHYVNAINTAPRNIGKDGKFQILVCLGTRDRLLPQWIPLLAECPAITRMYEESALLRDRMTVNSLIRILQTIQDFTIVLEGSLIKGVDV

SEQ ID NO: 9851 - protein, 738 aa, Artificial Sequence
  Description of Artificial Sequence: Synthetic coding sequence
MSGSCAAPGPGSGSSPAACRFAHYFVLCGIDADSGLEPDELAVLYQWLEADRHGKSQGAANTTSGENFDQSPLRRTFKSKVLAHYPQNIEWNPFDQDAVNMLCMPKGLSFRTQTDNKDPQFHSFIITREDGSRTYGFVLTFYEEVTSKQICTAMQTLYQMHNAEHYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQDYQRLMTVAEGITTLLFPFQWQHVYVPILPASLLHFLDAPVPYLMGLQSKEGTDRSKLELPQEANLCFVDIDNHFIELPEEFPQFPNKVDFIQELSEVLVQFGIPPEGSLHCSESTSKLKNMVLKDLVNDKKNGNVCTNNISMYELLKGNETIARLQALAKRTGVAVEKMDLSASLGEKDKDLKLHCEEAELRDYQLNVQLREVFANRFTQMFADYEAFVIQTAQDMESWLTNREQMQNFDKASFLSDQPEPYLPFLSRFIETQMFATFIDNKIMSQWEEKDPLLRVFDTRIDKIRLYNVRAPTLRTSIYQKCSTLKEAAQSIEQRLMKMDHTAIHPHLLDMKIGQGKYEQGFFPKLQSDVLATGPTSNNRWVSRSATAQRRKERLRQHSEHVGLDNDLREVCGLPSWGASQQAP

SEQ ID NO: 9852 - protein, 1274 aa, Artificial Sequence
  Description of Artificial Sequence: Synthetic coding sequence
MSGSCAAPGPGSGSSPAACRFAHYFVLCGIDADSGLEPDELAGENFDQSPLRRTFKSKVLAHYPQNIEWNPFDQDAVNMLCMPKGLSFRTQTDNKDPQFHSFIITREDGSRTYGFVLTFYEEVTSKQICTAMQTLYQMHNAEHYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQDYQRLMTVAEGITTLLFPFQWQHVYVPILPASLLHFLDAPVPYLMGLQSKEGTDRSKLELPQEANLCFVDIDNHFIELPEEFPQFPNKVDFIQELSEVLVQFGIPPEGSLHCSESTSKLKNMVLKDLVNDKKNGNVCTNNISMYELLKGNETIARLQALAKRTGVAVEKMDLSASLGEKDKDLKLHCEEAELRDYQLNVQLREVFANRFTQMFADYEAFVIQTAQDMESWLTNREQMQNFDKASFLSDQPEPYLPFLSRFIETQMFATFIDNKIMSQWEEKDPLLRVFDTRIDKIRLYNVRAPTLRTSIYQKCSTLKEAAQSIEQRLMKMDHTAIHPHLLDMKIGQGKYEQGFFPKLQSDVLATGPTSNNRWVSRSATAQRRKERLRQHSEHVGLDNDLREKYMQEARSLGKNLRQPKLSDLSPAVIAQTNCKFVEGLLKECRMKTKRMLVEKMGHEAVELGHGEANITGLEENTLIASLCDLLERIWSHGLQVKQGKSALWSHLIQFQDREEKQEHLAESPVALGPERRKSDSGVMLPTLRVSLIQDMRHIQNMSEIKTDVGRARAWIRLSLEKKLLSQHLKQLLSNQPLTKKLYKRYAFLRCEEEREQFLYHLLSLNAVDYFCFTSVFTTIMIPYRSVIIPIKKLSNAIITSNPWICVSGELGDTGVMQIPKNLLEMTFECQNLGKLTTVQIGHDNSGLLAKWLVDCVMVRNEITGHTYRFPCGRWLGKGIDDGSLERILIGELMTSASDEDLVKQCRTPPQQKSPTTARRLSITSLTGKNNKPNAGQIQEGIGEAVNNIVKHFHKPEKERGSLTVLLCGENGLVAALEQVFHHGFKSARIFHKNVFIWDFIEKVVAYFETTDQILDNEDDVLIQKSSCKTFCHYVNAINTAPRNIGKDGKFQILVCLGTRDRLLPQWIPLLAECPAITRMYEESALLRDRMTVNSLIRILQTIQDFTIVLEGSLIKGVDV

SEQ ID NO: 9853 - protein, 1309 aa, Artificial Sequence; identical to SEQ ID NO: 9850
  Description of Artificial Sequence: Synthetic coding sequence

SEQ ID NO: 9854 - protein, 132 aa, Artificial Sequence
  Description of Artificial Sequence: Synthetic coding sequence
MFLVGLTGGIASGKSSVIQVFQQLGCAVIDVDVMARHVVQPGYPAHRRIVEVFGTEVLLENGDINRKVLGDLIFNQPDRRQLLNAITHPEIRKEMMKETFKYFLREPRTSPRGKKHVPSALKEADSLMRRDT

SEQ ID NO: 9855 - protein, 231 aa, Artificial Sequence
  Description of Artificial Sequence: Synthetic coding sequence
MFLVGLTGGIASGKSSVIQVFQQLGCAVIDVDVMARHVVQPGYPAHRRIVEVFGTEVLLENGDINRKVLGDLIFNQPDRRQLLNAITHPEIRKEMMKETFKYFLRGYRYVILDIPLLFETKKLLKYMKHTVVVYCDRDTQLARLMRRNSLNRKDAEARINAQLPLTDKARMARHVLDNSGEWSVTKRQVILLHTELERSLEYLPLRFGVLTGLAAIASLLYLLTHYLLPYA

SEQ ID NO: 9856 - protein, 231 aa, Artificial Sequence; identical to SEQ ID NO: 9855
  Description of Artificial Sequence: Synthetic coding sequence

SEQ ID NO: 9857 - protein, 251 aa, Artificial Sequence
  Description of Artificial Sequence: Synthetic coding sequence
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 9858 - protein, 231 aa, Artificial Sequence
  Description of Artificial Sequence: Synthetic coding sequence
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSYPMDLGGRNFLSTPQFLYRWLPSRRGGVSGFGVPPASMRRAADQNGGGGRHNWGQGFRLGDQ

SEQ ID NO: 9859 - protein, 151 aa, Artificial Sequence
  Description of Artificial Sequence: Synthetic coding sequence
MSDIGDWFRSIPAITRYWFAATVAVPLVGKLGLISPAYLFLWPEAFLYRFQACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 9860 - protein, 239 aa, Artificial Sequence
  Description of Artificial Sequence: Synthetic coding sequence
MAYQSLRLEYLQIPPVSRAYTTACVLTTAAVQLELITPFQLYFNPELIFKHFQIWRLITNFLFFGPVGFNFLFNMIFLYRYCRMLEEGSFRGRTADFVFMFLFGGFLMTLFGLFVSLVFLGQAFTIMLVYVWSRRNPYVRMNFFGLLNFQAPFLPWVLMGFSLLLGNSIIVDLLGIAVGHIYFFLEDVFPNQPGGIRILKTPSILKAIFDTPDEDPNYNPLPEERPGGFAWGEGQRLGG

SEQ ID NO: 9861 - protein, 235 aa, Artificial Sequence
  Description of Artificial Sequence: Synthetic coding sequence
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFLKLLLDAPAEDPNYLPLPEEQPGPHLPPPQQ

SEQ ID NO: 9862 - protein, 205 aa, Artificial Sequence
  Description of Artificial Sequence: Synthetic coding sequence
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFL

SEQ ID NO: 9863 - protein, 239 aa, Artificial Sequence
  Description of Artificial Sequence: Synthetic coding sequence
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFLGLQSSKAPAGSSLTIWTQQSQGGPGTAGELAAPS

SEQ ID NO: 9864 - protein, 945 aa, Artificial Sequence
  Description of Artificial Sequence: Synthetic coding sequence
MAEGQGGGGQRWDWAGGGRAAEEEVVRRRCRRGEEAQVAQPWPEGSRGTAAGPPVEERFRQLHLRKQVSYRKAITKSGLQHLAPPPPTPGAPCSESERQIRSTVDWSESATYGEHIWFETNVSGDFCYVGEQYCVARMLKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 9865 - protein, 934 aa, Artificial Sequence
  Description of Artificial Sequence: Synthetic coding sequence
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENPCSPSGETCLHQAAALGQRTICHYIVEAGASLMKTDQQGDTPRQRAEKAQDTELAAYLENRQHYQMIQREDQETAV

SEQ ID NO: 9866 - protein, 1164 aa, Artificial Sequence
  Description of Artificial Sequence: Synthetic coding sequence
MAGAGGQHHPPGAAGGAAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPGSGDTESGSCEANSPGN

SEQ ID NO: 9867 - protein, 1220 aa, Artificial Sequence
  Description of Artificial Sequence: Synthetic coding sequence
MAGAGGQHHPPGAAGGAAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKDLGIPKVGHVKRILQGIKELGRSTPQSEV

SEQ ID NO: 9868 - protein, 1100 aa, Artificial Sequence
  Description of Artificial Sequence: Synthetic coding sequence
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKNTVGEKRDTKENGKHMDLGIPKVGHVKRILQGIKELGRSTPQSEV

SEQ ID NO: 9869 - protein, 1084 aa, Artificial Sequence
  Description of Artificial Sequence: Synthetic coding sequence
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKDLGIPKVGHVKRILQGIKELGRSTPQSEV

SEQ ID NO: 9870 - protein, 919 aa, Artificial Sequence
  Description of Artificial Sequence: Synthetic coding sequence
MWNISQGCTTGTPAPTPDPPSVTCAERVFLESPPMACPAKVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPGSGDTESGSCEANSPGN

SEQ ID NO: 9871 - protein, 1164 aa, Artificial Sequence; identical to SEQ ID NO: 9866
  Description of Artificial Sequence: Synthetic coding sequence

SEQ ID NO: 9872 - protein, 906 aa, Artificial Sequence
  Description of Artificial Sequence: Synthetic coding sequence
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 9873 - protein, 895 aa, Artificial Sequence
  Description of Artificial Sequence: Synthetic coding sequence
MWRYRSWDVPQIPSEAPQTQKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 9874 - protein, 929 aa, Artificial Sequence
  Description of Artificial Sequence: Synthetic coding sequence
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 9875 - protein, 1117 aa, Artificial Sequence
  Description of Artificial Sequence: Synthetic coding sequence
METFFRRHFRGKVPGPGEGQQRPSSVGLPTGKARRRSPAGQASSSLAQRRRSSAQLQGCLLSCGVRAQGSSRRRSSTVPPSCNPRFIVDKVLTPQPTTVGAQLLGAPLLLTGLVGMNEEEGVQEDVVAEASSAIQPGTKTPGPPPPRGAQPLLPLPRYLRRASSHLLPADAVYDHALWGLHGYYRRLSQRRPSGQHPGPGGRRASGTTAGTMLPTRVRPLSRRRQVALRRKAAGPQAWSALLAKAITKSGLQHLAPPPPTPGAPCSESERQIRSTVDWSESATYGEHIWFETNVSGDFCYVGEQYCVARMLKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 9876 - protein, 928 aa, Artificial Sequence
  Description of Artificial Sequence: Synthetic coding sequence
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 9877 - protein, 281 aa, Artificial Sequence
  Description of Artificial Sequence: Synthetic coding sequence
MEPRDGSPEARSSDSESASASSSGSERDAGPEPDKAPRRLNKRRFPGLRLFGHSKSKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 9878 - protein, 337 aa, Artificial Sequence
  Description of Artificial Sequence: Synthetic coding sequence
MAFFSRLNLQEGLQTFFVLQWIPVYIFLGAIPILLIPYFLLFSKFWPLAVLSLAWLTYDWNTHSQGGRRSAWVRNWTLWKYFRNYFPVKLVKTHDLSPKHNYIIANHPHGILSFGVFINFATEATGIARIFPSITPFVGTLERIFWIPIVREYVMSMGVCPVSSSALKYLLTQKGSGNAVVIVVGGAAEALLCRPGASTLFLKQRKGFVKMALQTGAYLVPSYSFGENEVFNQETFPEGTWLRLFQKTFQDTFKKILGLNFCTFHGRGFTRGSWGFLPFNRPITTVVGEPLPIPRIKRPNQKTVDKYHALYISALRKLFDQHKVEYGLPETQELTIT

SEQ ID NO: 9879 - protein, 88 aa, Artificial Sequence
  Description of Artificial Sequence: Synthetic coding sequence
MPAFAEFEKAAEEVRHLKTKPSDEEMLFIYGHYKQATVGDINTERPGMLDFTGKAKWDAWNELKGTSKEDAMKAYINKVEELKKKYGI

SEQ ID NO: 9880 - protein, 104 aa, Artificial Sequence
  Description of Artificial Sequence: Synthetic coding sequence
MWGDLWLLPPASANPGTGTEAEFEKAAEEVRHLKTKPSDEEMLFIYGHYKQATVGDINTERPGMLDFTGKAKWDAWNELKGTSKEDAMKAYINKVEELKKKYGI

SEQ ID NO: 9881 - protein, 87 aa, Artificial Sequence
  Description of Artificial Sequence: Synthetic coding sequence
MSQAEFEKAAEEVRHLKTKPSDEEMLFIYGHYKQATVGDINTERPGMLDFTGKAKWDAWNELKGTSKEDAMKAYINKVEELKKKYGI

SEQ ID NO: 9882 - protein, 104 aa, Artificial Sequence; identical to SEQ ID NO: 9880
  Description of Artificial Sequence: Synthetic coding sequence

SEQ ID NO: 9883 - protein, 129 aa, Artificial Sequence
  Description of Artificial Sequence: Synthetic coding sequence
MSQHRAGRRGGVGKRGVRGRELGGQGKYGAGCSECGTRRIAARGEAEFEKAAEEVRHLKTKPSDEEMLFIYGHYKQATVGDINTERPGMLDFTGKAKWDAWNELKGTSKEDAMKAYINKVEELKKKYGI

SEQ ID NO: 9884 - protein, 104 aa, Artificial Sequence; identical to SEQ ID NO: 9880
  Description of Artificial Sequence: Synthetic coding sequence

SEQ ID NO: 9885 - protein, 148 aa, Artificial Sequence
  Description of Artificial Sequence: Synthetic coding sequence
MERWGKGLHGLEERGDSVPIPKHRAGRRGGVGKRGVRGRELGGQGKYGAGCSECGTRRIAARGEAEFEKAAEEVRHLKTKPSDEEMLFIYGHYKQATVGDINTERPGMLDFTGKAKWDAWNELKGTSKEDAMKAYINKVEELKKKYGI

SEQ ID NO: 9886 - protein, 187 aa, Artificial Sequence
  Description of Artificial Sequence: Synthetic coding sequence
MFLLLNCIVAVSQNMGIGKNGDLPRPPLRNEFRYFQRMTTTSSVEGKQNLVIMGRKTWFSIPEKNRPLKDRINLVLSRELKEPPQGAHFLARSLDDALKLTERPELANKVDMIWIVGGSSVYKEAMNHLGHLKLFVTRIMQDFESDTFFSEIDLEKYKLLPEYPGVLSDVQEGKHIKYKFEVCEKDD

SEQ ID NO: 9887 - protein, 187 aa, Artificial Sequence; identical to SEQ ID NO: 9886
  Description of Artificial Sequence: Synthetic coding sequence

SEQ ID NO: 9888 - protein, 187 aa, Artificial Sequence; identical to SEQ ID NO: 9886
  Description of Artificial Sequence: Synthetic coding sequence

SEQ ID NO: 9889 - protein, 114 aa, Artificial Sequence
  Description of Artificial Sequence: Synthetic coding sequence
MFLLLNCIVAVSQNMGIGKNGDLPRPPLRNEFRYFQRMTTTSSVEGKQNLVIMGRKTWFSIPEKNRPLKDRINLVLSRELKEPPQGAHFLARSLDDALKLTERPELANKVDMIW

SEQ ID NO: 9890 - protein, 198 aa, Artificial Sequence
  Description of Artificial Sequence: Synthetic coding sequence
MPEQSNDYRVVVFGAGGVGKSSLVLRFVKGTFRDTYIPTIEDTYRQVISCDKSVCTLQITDTTGSHQFPAMQRLSISKGHAFILVFSVTSKQSLEELGPIYKLIVQIKGSVEDIPVMLVGNKCDETQREVDTREAQAVAQEWKCAFMETSAKMNYNVKELFQELLTLETRRNMSLNIDGKRSGKQKRTDRVKGKCTLM

SEQ ID NO: 9891 - protein, 199 aa, Artificial Sequence
  Description of Artificial Sequence: Synthetic coding sequence
MPEQSNDYRVAVFGAGGVGKSSLVLRFVKGTFRESYIPTVEDTYRQVISCDKSICTLQITDTTGSHQFPAMQRLSISKGHAFILVYSITSRQSLEELKPIYEQICEIKGDVESIPIMLVGNKCDESPSREVQSSEAEALARTWKCAFMETSAKLNHNVKELFQELLNLEKRRTVSLQIDGKKSKQQKRKEKLKGKCVIM

SEQ ID NO: 9892 - protein, 229 aa, Artificial Sequence
  Description of Artificial Sequence: Synthetic coding sequence
MGNASFGSKEQKLLKRLRLLPALLILRAFKPHRKIRDYRVVVVGTAGVGKSTLLHKWASGNFRHEYLPTIENTYCQLLGCSHGVLSLHITDSKSGDGNRALQRHVIARGHAFVLVYSVTKKETLEELKAFYELICKIKGNNLHKFPIVLVGNKSDDTHREVALNDGATCAMEWNCAFMEISAKTDVNVQELFHMLLNYKKKPTTGLQEPEKKSQMPNTTEKLLDKCIIM

SEQ ID NO: 9893 - protein, 229 aa, Artificial Sequence; identical to SEQ ID NO: 9892
  Description of Artificial Sequence: Synthetic coding sequence

SEQ ID NO: 9894 - protein, 166 aa, Artificial Sequence
  Description of Artificial Sequence: Synthetic coding sequence
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRF

SEQ ID NO: 9895 - protein, 139 aa, Artificial Sequence
  Description of Artificial Sequence: Synthetic coding sequence
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQE

SEQ ID NO: 9896 - protein, 251 aa, Artificial Sequence
  Description of Artificial Sequence: Synthetic coding sequence
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWP

SEQ ID NO: 9897 - protein, 139 aa, Artificial Sequence; identical to SEQ ID NO: 9895
  Description of Artificial Sequence: Synthetic coding sequence

SEQ ID NO: 9898 - protein, 251 aa, Artificial Sequence; identical to SEQ ID NO: 9896
  Description of Artificial Sequence: Synthetic coding sequence

SEQ ID NO: 9899 - protein, 139 aa, Artificial Sequence; identical to SEQ ID NO: 9895
  Description of Artificial Sequence: Synthetic coding sequence

SEQ ID NO: 9900 - protein, 251 aa, Artificial Sequence; identical to SEQ ID NO: 9896
  Description of Artificial Sequence: Synthetic coding sequence

SEQ ID NO: 9901 - protein, 251 aa, Artificial Sequence; identical to SEQ ID NO: 9896
  Description of Artificial Sequence: Synthetic coding sequence

SEQ ID NO: 9902 - protein, 139 aa, Artificial Sequence; identical to SEQ ID NO: 9895
  Description of Artificial Sequence: Synthetic coding sequence

SEQ ID NO: 9903 - protein, 63 aa, Artificial Sequence
  Description of Artificial Sequence: Synthetic coding sequence
MGPEALSSLLLLLLVASGDADMKGHFDPAKCRYALGMQDRTIPDSDISASSSWSDSTAARHSR

SEQ ID NO: 9904 - protein, 251 aa, Artificial Sequence; identical to SEQ ID NO: 9896
  Description of Artificial Sequence: Synthetic coding sequence

SEQ ID NO: 9905 - protein, 139 aa, Artificial Sequence; identical to SEQ ID NO: 9895
  Description of Artificial Sequence: Synthetic coding sequence

SEQ ID NO: 9906 - protein, 139 aa, Artificial Sequence; identical to SEQ ID NO: 9895
  Description of Artificial Sequence: Synthetic coding sequence

SEQ ID NO: 9907 - protein, 63 aa, Artificial Sequence; identical to SEQ ID NO: 9903
  Description of Artificial Sequence: Synthetic coding sequence

SEQ ID NO: 9908 - protein, 209 aa, Artificial Sequence
  Description of Artificial Sequence: Synthetic coding sequence
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVY

SEQ ID NO: 9909 - protein, 139 aa, Artificial Sequence; identical to SEQ ID NO: 9895
  Description of Artificial Sequence: Synthetic coding sequence

SEQ ID NO: 9910 - protein, 139 aa, Artificial Sequence; identical to SEQ ID NO: 9895
  Description of Artificial Sequence: Synthetic coding sequence

SEQ ID NO: 9911 - protein, 139 aa, Artificial Sequence; identical to SEQ ID NO: 9895
  Description of Artificial Sequence: Synthetic coding sequence

SEQ ID NO: 9912 - protein, 47 aa, Artificial Sequence
  Description of Artificial Sequence: Synthetic coding sequence
SEAVYLNDSTYDGHTVGGLQYGGLGQLADGVVGLDDFRKSQELRVWP

SEQ ID NO: 9913 - protein, 147 aa, Artificial Sequence
  Description of Artificial Sequence: Synthetic coding sequence
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDP

SEQ ID NO: 9914 - protein, 139 aa, Artificial Sequence; identical to SEQ ID NO: 9895
  Description of Artificial Sequence: Synthetic coding sequence

SEQ ID NO: 9915 - protein, 251 aa, Artificial Sequence
  Description of Artificial Sequence: Synthetic coding sequence
MPHLASLFTASSRCCPHPLRPEGSGAMGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRGEWLSFLGICFLSRGLEGGECGEWASRIPSPAGKLSL

SEQ ID NO: 9916 - protein, 539 aa, Artificial Sequence
  Description of Artificial Sequence: Synthetic coding sequence
MVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMAG

SEQ ID NO: 9917 - protein, 715 aa, Artificial Sequence
  Description of Artificial Sequence: Synthetic coding sequence
MVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMADYQQPLMIGTGTVTRKGSTFRPMDTDAEEAGVSTDAGGHYDCPQRAGRHEYALPLAPPEPEYATPIVERHVLRAHTFSAQSGYRVPGPQPGHKHSLSSGGFSPVAGVGAQDGDYQRPHSAQPADRGYDRPKAVSALATESGHPDSQKPPTHPGTSDSYSAPRDCLTPLNQTAMTALL

SEQ ID NO: 9918 - protein, 516 aa, Artificial Sequence
  Description of Artificial Sequence: Synthetic coding sequence
MVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGINITTVAIPLVLLVVLVFAGMGIFAAFRKKKKKGSPYGSAEAQKTDCWKQIKYPFARHQSAEFTISYDNEKEMTQKLDLITSDMADYQQPLMIGTGTVTRKGSTFRPMDTDAEEAGVSTDAGGHYDCPQRAGRHEYALPLAPPEPEYATPIVERHVLRAHTFSAQSGYRVPGPQPGHKHSLSSGGFSPVAGVGAQDGDYQRPHSAQPADRGYDRPKAVSALATESGHPDSQKPPTHPGTSDSYSAPRDCLTPLNQTAMTALL

SEQ ID NO: 9919 - protein, 205 aa, Artificial Sequence
  Description of Artificial Sequence: Synthetic coding sequence
MNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMAASPEPVSEPLPP

SEQ ID NO: 9920 - protein, 775 aa, Artificial Sequence
  Description of Artificial Sequence: Synthetic coding sequence
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGWWKGMKQFLPAKAVDHEETPVRYSSSEVNHLSPREVTTVLQADSAEYAQPLVGGIVGTLHQRSTFKPEEGKEAGYADLDPYNSPGQEVYHAYAEPLPITGPEYATPIIMDMSGHPTTSVGQPSTSTFKATGNQPPPLVGTYNTLLSRTDSCSSAQAQYDTPKAGKPGLPAPDELVYQVPQSTQEVSGAGRDGECDVFKEIL

SEQ ID NO: 9921 - protein, 789 aa, Artificial Sequence
  Description of Artificial Sequence: Synthetic coding sequence
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGFYLMVSLACRHNEGWWKGMKQFLPAKAVDHEETPVRYSSSEVNHLSPREVTTVLQADSAEYAQPLVGGIVGTLHQRSTFKPEEGKEAGYADLDPYNSPGQEVYHAYAEPLPITGPEYATPIIMDMSGHPTTSVGQPSTSTFKATGNQPPPLVGTYNTLLSRTDSCSSAQAQYDTPKAGKPGLPAPDELVYQVPQSTQEVSGAGRDGECDVFKEIL

SEQ ID NO: 9922 - protein, 379 aa, Artificial Sequence
  Description of Artificial Sequence: Synthetic coding sequence
MPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQGSNYLFGHCIQFWNLSSGKYCPAGCLLPFAEISGTIPHGYRDSSPLCMAGVHAGVVSNTLGGQISVVISKGIPYYESSLANNVTSVVSVSLLMVFILFFVSGCYGTLGMESGDRGSSNNSIVLEWTDHTGQENSWKPKKQAEKTWTALGFATDEYQWLQIDLNKEKKITGIITTGSTMVTITMCLPTESCTVMMGRNGLCTESLVEQDKIFQGNKDYHQDVRNNFLPPIIARFIR

SEQ ID NO: 9923 - protein, 627 aa, Artificial Sequence
  Description of Artificial Sequence: Synthetic coding sequence
MNLIFHKDILFGIPANKVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKVEQCRFCMVHLKTCTNTGQSK

SEQ ID NO: 9924 - protein, 693 aa, Artificial Sequence
  Description of Artificial Sequence: Synthetic coding sequence
MIDLFKAEWVSSVCVQVSRNGRTDQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTGVIKLSSAVEVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 9925 - protein, 683 aa, Artificial Sequence
  Description of Artificial Sequence: Synthetic coding sequence
MIDLFKAEWVSSVCVQVSRNGRTDQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 9926 - protein, 929 aa, Artificial Sequence
  Description of Artificial Sequence: Synthetic coding sequence
MKGLSGSRSHHHGVTCDSACDSLSHHSDRKPYLLSPVEHHPADHPYYTQRNSFQAECVGPFSDPLASSTFPRRHYTSQQELKDECALVPRTLATKANRIPANLLDQFERQLPLSRDGYHTLQYKRTAVEHRSDSPGRIRHLVHSVQKLFTKSHSLEGPSKGSVNGGKASPDEAQAARYGKRSKSKERRAEPKARPSTSPGWWSSDDNLDGDMCIYHAPSGVMTMGRCPDRSASQYFLEAYNTISEQAVKASRSNNDVKCSTCANLPVSLDTPLLKKSAWSSTLTVSRAREVYQKASVNMDQAMVKSESCQQERSCQYLQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKVEQCRFCMVHLKTCTNTGQSK

SEQ ID NO: 9927 - protein, 977 aa, Artificial Sequence
  Description of Artificial Sequence: Synthetic coding sequence
MKGLSGSRSHHHGVTCDSACDSLSHHSDRKPYLLSPVEHHPADHPYYTQRNSFQAECVGPFSDPLASSTFPRRHYTSQQELKDECALVPRTLATKANRIPANLLDQFERQLPLSRDGYHTLQYKRTAVEHRSDSPGRIRHLVHSVQKLFTKSHSLEGPSKGSVNGGKASPDEAQAARYGKRSKSKERRAEPKARPSTSPGWWSSDDNLDGDMCIYHAPSGVMTMGRCPDRSASQYFLEAYNTISEQAVKASRSNNDVKCSTCANLPVSLDTPLLKKSAWSSTLTVSRAREVYQKASVNMDQAMVKSESCQQERSCQYLQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 9928 - protein, 675 aa, Artificial Sequence
  Description of Artificial Sequence: Synthetic coding sequence
MNLIFHKDILFGIPANKVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 9929 - protein, 929 aa, Artificial Sequence; identical to SEQ ID NO: 9926
  Description of Artificial Sequence: Synthetic coding sequence

SEQ ID NO: 9930 - protein, 661 aa, Artificial Sequence
  Description of Artificial Sequence: Synthetic coding sequence
MDLKTLKLFNSQLRCGWLLYIWNKAFMAHLRVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 9931 - protein, 685 aa, Artificial Sequence
  Description of Artificial Sequence: Synthetic coding sequence
MNLIFHKDILFGIPANKVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTGVIKLSSAVEVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 9932 - protein, 979 aa, Artificial Sequence
  Description of Artificial Sequence: Synthetic coding sequence
MRGYHGDRGSHPRPARFADQQHMDVGPAARAPYLLGSREAFSTEPRFCAPRAGLGHISPEGPLSLSEGPSVGPEGGPAGAGVGGGSSTFPRMYPGQGPFDTCEDCVGHPQGKGAPRLPPTLLDQFEKQLPVQQDGFHTLPYQRGPAGAGPGPAPGTGTAPEPRSESPSRIRHLVHSVQKLFAKSHSLEAPGKRDYNGPKAEGRGGSGGDSYPGPGSGGPHTSHHHHHHHHHHHHQSRHGKRSKSKDRKGDGRHQAKSTGWWSSDDNLDSDSGFLAGGRPPGEPGGPFCLEGPDGSYRDLSFKGRSGGSEGRCLACTGMSMSLDGQSVKRSAWHTMMVSQGRDGYPGAGPGKGLLGPETKAKARTYHYLQVPQDDWGGYPTGGKDGEIPCRRMRSGSYIKAMGDEESGDSDGSPKTSPKAVARRFTTRRSSSVDQARINCCVPPRIHPRSSIPGYSRSLTTGQLSDELNQQLEAVCGSVFGELESQAVDALDLPGCFRMRSHSYLRAIQAGCSQDDDCLPLLATPAAVSGRPGSSFNFRKAPPPIPPGSQAPPRISITAQSSTDSAHESFTAAEGPARRCSSADGLDGPAMGARTLELAPVPPRASPKPPTLIIKTIPGREELRSLARQRKWRPSIGVQVETISDSDTENRSRREFHSIGVQVEEDKRRARFKRSNSVTAGVQADLELEGLAGLATVATEDKALQFGRSFQRHASEPQPGPRAPTYSVFRTVHTQGQWAYREGYPLPYEPPATDGSPGPAPAPTPGPGAGRRDSWIERGSRSLPDSGRASPCPRDGEWFIKMLRAEVEKLEHWCQQMEREAEDYELPEEILEKIRSAVGSTQLLLSQKVQQFFRLCQQSMDPTAFPVPTFQDLAGFWDLLQLSIEDVTLKFLELQQLKANSWKLLEPKEEKKVPPPIPKKPLRGRGVPVKERSLDSVDRQRQEARKRLLAAKRAASFRHSSATESADSIEIYIPEAQTRL

SEQ ID NO: 9933 - protein, 979 aa, Artificial Sequence; identical to SEQ ID NO: 9932
  Description of Artificial Sequence: Synthetic coding sequence

SEQ ID NO: 9934 - protein, 265 aa, Artificial Sequence
  Description of Artificial Sequence: Synthetic coding sequence
MSMSLDGQSVKRSAWHTMMVSQGRDGYPGAGPGKGLLGPETKAKARTYHYLQVPQDDWGGYPTGGKDGEIPCRRMRSGSYIKAMGDEESGDSDGSPKTSPKAVARRFTTRRSSSVDQARINCCVPPRIHPRSSIPGYSRSLTTGQLSDELNQQMEREAEDYELPEEILEKIRSAVGSTQLLLSQKVQQFFRLCQQSMDPTAFPVPTFQDLAGFWDLLQLSIEDVTLKFLELQQLKANSWKLLEPKEEKKVPPPIPTRPPGPSHSR

SEQ ID NO: 9935 - protein, 736 aa, Artificial Sequence
  Description of Artificial Sequence: Synthetic coding sequence
MAGSSTGGGGVGETKVIYHLDEEETPYLVKIPVPAERITLGDFKSVLQRPAGAKYFFKSMDQDFGVVKEEISDDNARLPCFNGRVVSWLVSSDNPQPEMAPPVHEPRAELAPPAPPLPPLPPERTSGIGDSRPPSFHPNVSSSHENLEPETETESVVSLRRERPRRRDSSEHGAGGHRTGGPSRLERHLAGYESSSTLMTSELESTSLGDSDEEDTMSRFSSSTEQSSASRLLKRHRRRRKQRPPRLERTSSFSSVTDSTMSLNIITVTLNMEKYNFLGISIVGQSNERGDGGIYIGSIMKGGAVAADGRIEPGDMLLQVNDMNFENMSNDDAVRVLRDIVHKPGPIVLTVAKCWDPSPQAYFTLPRNEPIQPIDPAAWVSHSAALTGTFPAYPGSSSMSTITSGSSLPDGCEGRGLSVHTDMASVTKAMAAPESGLEVRDRMWLKITIPNAFLGSDVVDWLYHHVEGFPERREARKYASGLLKAGLIRHTVNKITFSEQCYYVFGDLSGGCESYLVNLSLNDNDGSSGASDQDTLAPLPGATPWPLLPTFSYQYPAPHPYSPQPPPYHELSSYTYGGGSASSQHSEGSRSSGSTRSDGGAGRTGRPEERAPESKSGSGSESEPSSRGGSLRRGGEASGTSDGGPPPSRGSTGGAPNLRAHPGLHPYGPPPGMALPYNPMMVVMMPPPPPPVPPAVQPPGAPPVRDLGSVPPELTASRQSFHMAMGNPSEFFVDVM

SEQ ID NO: 9936 - protein, 1524 aa, Artificial Sequence
  Description of Artificial Sequence: Synthetic coding sequence
MAMSNGNNDFVVLSNSSIATSAANPSPLTPCDGDHAAQQLTPKEATRTKVSPNGCLQLNGTVKSSFLPLDNQRMPQMLPQCCHPCPYHHPLTSHSSHQECHPEAGPAAPSALASCCMQPHSEYSASLCPNHSPVYQTTCCLQPSPSFCLHHPWPDHFQHQPVQQHIANIRPSRPFKLPKSYAALIADWPVVVLGMCTMFIVVCALVGVLVPELPDFSDPLLGFEPRGTAIGQRLVTWNNMVKNTGYKATLANYPFKYADEQAKSHRDDRWSDDHYEREKREVDWNFHKDSFFCDVPSDRYSRVVFTSSGGETLWNLPAIKSMCNVDNSRIRSHPQFGDLCQRTTAASCCPSWTLGNYIAILNNRSSCQKIVERDVSHTLKLLRTCAKHYQNGTLGPDCWDMAARRKDQLKCTNVPRKCTKYNAVYQILHYLVDKDFMTPKTADYATPALKYSMLFSPTEKGESMMNIYLDNFENWNSSDGVTTITGIEFGIKHSLFQDYLLMDTVYPAIAIVIVLLVMCVYTKSMFITLMTMFAIISSLIVSYFLYRVVFHFEFFPFMNLTALIILVGIGADDAFVLCDVWNYTKFDKPHAETSETVSITLQHAALSMFVTSFTTAAAFYANYVSNITAIRCFGVYAGTAILVNYVLMVTWLPAVVVLHERYLLNIFTCFKKPQQQIYDNKSCWTVACQKCHKVLFAISEASRIFFEKVLPCIVIKFRYLWLFWFLALTVGGAYIVCINPKMKLPSLELSEFQVFRSSHPFERYDAEYKKLFMFERVHHGEELHMPITVIWGVSPEDNGNPLNPKSKGKLTLDSSFNIASPASQAWILHFCQKLRNQTFFYQTDEQDFTSCFIETFKQWMENQDCDEPALYPCCSHWSFPYKQEIFELCIKRAIMELERSTGYHLDSKTPGPRFDINDTIRAVVLEFQSTYLFTLAYEKMHQFYKEVDSWISSELSSAPEGLSNGWFVSNLEFYDLQDSLSDGTLIAMGLSVAVAFSVMLLTTWNIIISLYAIISIAGTIFVTVGSLVLLGWELNVLESVTISVAVGLSVDFAVHYGVAYRLAPDPDREGKVIFSLSRVGSAMAMAALTTFVAGAMMMPSTVLAYTQLGTFMMLIMCISWAFATFFFQCMCRCLGPQGTCGQIPLPKKLQCSAFSHALSTSPSDKGQSKTHTINAYHLDPRGPKSELEHEFYELEPLASHSCTAPEKTTYEETHICSEFFNSQAKNLGMPVHAAYNSELSKSTESDAGSALLQPPLEQHTVCHFFSLNQRCSCPDAYKHLNYGPHSCQQMGDCLCHQCSPTTSSFVQIQNGVAPLKATHQAVEGFVHPITHIHHCPCLQGRVKPAGMQNSLPRNFFLHPVQHIQAQEKIGKTNVHSLQRSIEEHLPKMAEPSSFVCRSTGSLLKTCCDPENKQRELCKNRDVSNLESSGGTENKAGGKVELSLSQTDASVNSEHFNQNEPKVLFNHLMGEAGCRSCPNNSQSCGRIVRVKCNSVDCQMPNMEANVPAVLTHSELSGESLLIKTL

SEQ ID NO: 9937 - protein, 184 aa, Artificial Sequence
  Description of Artificial Sequence: Synthetic coding sequence
MAMSNGNNDFVVLSNSSIATSAANPSPLTPCDGDHAAQQLTPKEATRTKVSPNGCLQLNGTVKSSFLPLDNQRMPQMLPQCCHPCPYHHPLTSHSSHQECHPEAGPAAPSALASCCMQPHSEYSASLCPNHSPVYQTTCCLQPSPSFCLHHPWPDHFQHQPVQQHIANIRFTRKTKCASWLLQM

SEQ ID NO: 9938 - protein, 1401 aa, Artificial Sequence
  Description of Artificial Sequence: Synthetic coding sequence
MDGDSSSSSGGSGPAPGPGPEGEQRPEGEPLAPDGGSPDSTQTKAVPPEASPERSCSLHSCPLEDPSSSSGPPPTTSTLQPVGPSSPLAPAHFTYPRALQEYQGGSSLPGLGDRAALCSHGSSLSPSPAPSQRDGTWKPPAVQHHVVSVRQERAFQMPKSYSQLIAEWPVAVLMLCLAVIFLCTLAGLLGARLPDFSKPLLGFEPRDTDIGSKLVVWRALQALTGPRKLLFLSPDLELNSSSSHNTLRPAPRGSAQESAVRPRRMVEPLEDRRQENFFCGPPEKSYAKLVFMSTSSGSLWNLHAIHSMCRMEQDQIRSHTSFGALCQRTAANQCCPSWSLGNYLAVLSNRSSCLDTTQADAARTLALLRTCALYYHSGALVPSCLGPGQNKSPRCAQVPTKCSQSSAIYQLLHFLLDRDFLSPQTTDYQVPSLKYSLLFLPTPKGASLMDIYLDRLATPWGLADNYTSVTGMDLGLKQELLRHFLVQDTVYPLLALVAIFFGMALYLRSLFLTLMVLLGVLGSLLVAFFLYQVAFRMAYFPFVNLAALLLLSSVCANHTLIFFDLWRLSKSQLPSGGLAQRVGRTMHHFGYLLLVSGLTTSAAFYASYLSRLPAVRCLALFMGTAVLVHLALTLVWLPASAVLHERYLARGCARRARGRWEGSAPRRLLLALHRRLRGLRRAAAGTSRLLFQRLLPCGVIKFRYIWICWFAALAAGGAYIAGVSPRLRLPTLPPPGGQVFRPSHPFERFDAEYRQLFLFEQLPQGEGGHMPVVLVWGVLPVDTGDPLDPRSNSSLVRDPAFSASGPEAQRWLLALCHRARNQSFFDTLQEGWPTLCFVETLQRWMESPSCARLGPDLCCGHSDFPWAPQFFLHCLKMMALEQGPDGTQDLGLRFDAHGSLAALVLQFQTNFRNSPDYNQTQLFYNEVSHWLAAELGMAPPGLRRGWFTSRLELYSLQHSLSTEPAVVLGLALALAFATLLLGTWNVPLSLFSVAAVAGTVLLTVGLLVLLEWQLNTAEALFLSASVGLSVDFTVNYCISYHLCPHPDRLSRVAFSLRQTSCATAVGAAALFAAGVLMLPATVLLYRKLGIILMMVKCVSCGFASFFFQSLCCFFGPEKNCGQILWPCAHLPWDAGTGDPGGEKAGRPRPGSVGGMPGSCSEQYELQPLARRRSPSFDTSTATSKLSHRPSVLSEDLQLHDGPCCSRPPPAPASPRELLLDHQAVFSQCPALQTSSPYKQAGPSPKTRARQDSQGEEAEPLPASPEAPAHSPKAKAADPPDGFCSSASTLEGLSVSDETCLSTSEPSARVPDSVGVSPDDLDDTGQPVLERGQLNGKRDTLWLALRETVYDPSLPASHHSSLSWKGRGGPGDGSPVVLPNSQPDLPDVWLRRPSTHTSGYSS

SEQ ID NO: 9939 - protein, 471 aa, Artificial Sequence
  Description of Artificial Sequence: Synthetic coding sequence
MGGTQVKCLTSPSPIHSAKSESIITQSEEKADFVIIPAEGIENRTEGTDSPLSRDWRPGPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 9940 - protein, 682 aa, Artificial Sequence
  Description of Artificial Sequence: Synthetic coding sequence
MLACLTRGNLLDVLQEGFNEQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSSLTSPSPIHSAKSESIITQSEEKADFVIIPAEGIENRTEGTDSPLSRDWRPGPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 9941 - protein, 219 aa, Artificial Sequence
  Description of Artificial Sequence: Synthetic coding sequence
MLACLTRGNLLDVLQEGFNEQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSR

SEQ ID NO: 9942 - protein, 379 aa, Artificial Sequence
  Description of Artificial Sequence: Synthetic coding sequence
MEGNRDEAEKCVEIAREALNAGNREKAQRFLQKAEKLYPLPSARALLEIIMKNGSTAGNSPHCRKPSGSGDQSKPNCTKDSTSGSGEGGKGYTKDQVDGVLSINKCKNYYEVLGVTKDAGDEDLKKAYRKLALKFHPDKNHAPGATDAFKKIGNAYAVLSNPEKRKQYDLTGNEEQACNHQNNGRFNFHRGCEADITPEDLFNIFFGGGFPSGSVHSFSNGRAGYSQQHQHRHSGHEREEERGDGGFSVFIQLMPIIVLILVSLLSQLMVSNPPYSLYPRSGTGQTIKMQTENLGVVYYVNKDFKNEYKGMLLQKVEKSVEEDYVTNIRNNCWKERQQKTDMQYAAKVYRDDRLRRKADALSMDNCKELERLTSLYKGG

SEQ ID NO: 9943 - protein, 337 aa, Artificial Sequence
  Description of Artificial Sequence: Synthetic coding sequence
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIYSGCTKRMKISRKRLNADGRSYRSEDKILTIEIKKGWKEGTKITFPREGDETPNSIPADIVFIIKDKDHPKFKRDGSNIIYTAKISLREALCGCSINVPTLDGRNIPMSVNDIVKPGMRRRIIGYGLPFPKNPDQRGDLLIEFEVSFPDTISSSSKEVLRKHLPAS

SEQ ID NO: 9944 - protein, 172 aa, Artificial Sequence
  Description of Artificial Sequence: Synthetic coding sequence
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIY

SEQ ID NO: 9945 - protein, 360 aa, Artificial Sequence
  Description of Artificial Sequence: Synthetic coding sequence
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKDEETRKDYDYMLDHPEEYYSHYYHYYSRRLAPKVDVRVVILVSVCAISVFQFFSWWNSYNKAISYLATVPKYRIQATEIAKQQGLLKKAKEKGKNKKSKEEIRDEEENIIKNIIKSKIDIKGGYQKPQICDLLLFQIILAPFHLCSYIVWYCRWIYNFNIKGKEYGEEERLYIIRKSMKMSKSQFDSLEDHQKETFLKRELWIKENYEVYKQEQEEELKKKLANDPRWKRYRRWMKNEGPGRLTFVDD

SEQ ID NO: 9946 - protein, 153 aa, Artificial Sequence
  Description of Artificial Sequence: Synthetic coding sequence
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKVSQAAAELQQYCMQNACKDALLVGVPAGSNPFREPRSCALL

SEQ ID NO: 9947 - protein, 109 aa, Artificial Sequence
  Description of Artificial Sequence: Synthetic coding sequence
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQV

SEQ ID NO: 9948 - protein, 554 aa, Artificial Sequence
  Description of Artificial Sequence: Synthetic coding sequence
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQLVAIYEVLKDDERRQRYDDILINGLPDWRQPVFYYRRVRKMSNAELALLLFIILTVGHYAVVWSIYLEKQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 9949 - protein, 116 aa, Artificial Sequence
  Description of Artificial Sequence: Synthetic coding sequence
  MOD_RES (1)..(1): Any amino acid
XGRRQLGLVPFPPPPPRTPLLWLLLLLLAAVAPARGWESGDLELFDLVEEVQLNFYQFLGVQQDASSADIRKAYRKLSLTLHPDKNKDENAETQFRQLVAIYEVLKDDERRQRMNY

SEQ ID NO: 9950 - protein, 507 aa, Artificial Sequence
  Description of Artificial Sequence: Synthetic coding sequence
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 9951 - protein, 318 aa, Artificial Sequence
  Description of Artificial Sequence: Synthetic coding sequence
MLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWHCSSPLLQVQRPHRNTRACAPEPSFRPFLHVPTWDAECSGARTPSTAWTSAAVKLREACLSGPGSGSHQLLLLTPRSKRRTGGG

SEQ ID NO: 9952 - protein, 469 aa, Artificial Sequence
  Description of Artificial Sequence: Synthetic coding sequence
MKVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 9953 - protein, 559 aa, Artificial Sequence
  Description of Artificial Sequence: Synthetic coding sequence
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 9954 - protein, 324 aa, Artificial Sequence
  Description of Artificial Sequence: Synthetic coding sequence
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGERMTDCLIIGLIDICQRCSPQPASASCRLCCCHVTLLELYIPVPSRTTAVSSFPICFVTTNCALQFSSRGIRPGLTTVLARNLDKNTVGYLQWRWGIQSAMNTSIVRDTKTSHFT

SEQ ID NO: 9955 - protein, 332 aa, Artificial Sequence
  Description of Artificial Sequence: Synthetic coding sequence
ASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWHCSSPLLQVQRPHRNTRACAPEPSFRPFLHVPTWDAECSGARTPSTAWTSAAVKLREACLSGPGSGSHQLLLLTPRSKRRTGGG

SEQ ID NO: 9956 - protein, 521 aa, Artificial Sequence [sequence omitted]

SEQ ID NO: 9957 - protein, 702 aa, Artificial Sequence
  Description of Artificial Sequence: Synthetic coding sequence
MAQKHPGERGLYGAHHSGGASLRTLGPSVDPEIPSFSGLRDSAGTAPNGTRCLTEHSGPKHTQHPNPAHWLDPSHGPPGGPGPPRDAEDPDQSETSSEEESGVDQELSKENETGNQKDGNSFLSIPSACNCQGTPGIPEGPYSEGGNGSSSNFCHHCTSPALGEDELEEEYDDEESLKFPSDFSRVSSGKKPPSRRQRHRFPTKEDTREGGRRDPRSPGRHRLGRKRSQADKRKGLGLWGAEELCQLGQAGFWWLIELLVLVGEYVETCGHLIYACRQLKSSDLDLFRVWMGVWTGRLGGWAQVMFQFLSQGFYCGVGLFTRFLKLLGALLLLALALFLGFLQLGWRFLVGLGDRLGWRDKATWLFSWLDSPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVLRAAWDIVSNAEKRKEYEMKRMAENELSRSVNEFLSKLQDDLKEAMNTMMCSRCQGKHRRFEMDREPKSARYCAECNRLHPAEEGDFWAESSMLGLKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKVRRPFQR

SEQ ID NO: 9958 - protein, 702 aa, Artificial Sequence; identical to SEQ ID NO: 9957
  Description of Artificial Sequence: Synthetic coding sequence

SEQ ID NO: 9959 - protein, 702 aa, Artificial Sequence; identical to SEQ ID NO: 9957
  Description of Artificial Sequence: Synthetic coding sequence

SEQ ID NO: 9960 - protein, 412 aa, Artificial Sequence
  Description of Artificial Sequence: Synthetic coding sequence
MGVWTGRLGGWAQVMFQFLSQGFYCGVGLFTRFLKLLGALLLLALALFLGFLQLGWRFLVGLGDRLGWRDKATWLFSWLDSPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVLRAAWDIVSNAEKRKEYEMKRMAENELSRSVNEFLSKLQDDLKEAMNTMMCSRCQGKHRRFEMDREPKSARYCAECNRLHPAEEGDFWAESSMLGLKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKVRRPFQR

SEQ ID NO: 9961 - protein, 191 aa, Artificial Sequence
  Description of Artificial Sequence: Synthetic coding sequence
RKRMAENELSRSVNEFLSKLQDDLKEAMNTMMCSRCQGKHRRFEMDREPKSARYCAECNRLHPAEEGDFWAESSMLGLKITYFALMDGKVYDITEWAGCQRVGISPDTHRVPYHISFGSRIPGTRGRQRATPDAPPADLQDFLSRIFQVPPGQMPMGTSLQLLSLPLEPLQPLSPTAQYPREKPNLSGGRK

SEQ ID NO: 9962 - protein, 79 aa, Artificial Sequence
  Description of Artificial Sequence: Synthetic coding sequence
MAQKHPGERGLYGAHHSGGASLRTLGPSVDPEIPSFSGLRDSAGTAPNGTRCLTEHSGPKHTQHPNPAHWLDPSHGPPG

SEQ ID NO: 9963 - protein, 151 aa, Artificial Sequence
  Description of Artificial Sequence: Synthetic coding sequence
MAQKHPGERGLYGAHHSGGASLRTLGPSVDPEIPSFSGLRDSAGTAPNGTRCLTEHSGPKHTQHPNPAHWLDPSHGPPGGPGPPRDAEDPDQSETSSEEESGVDQELSKENETGNQKDGNSFLSIPSACNCQGTPGIPEGPYSEGGNGSSS

SEQ ID NO: 9964 - protein, 150 aa, Artificial Sequence
  Description of Artificial Sequence: Synthetic coding sequence
MAARGVIAPVGESLRYAEYLQPSAKRPDADVDQQRLVRSLIAVGLGVAALAFAGRYAFRIWKPLEQVITETAKKISTPSFSSYYKGGFEQKMSRREAGLILGVSPSAGKAKIRTAHRRVMILNHPDKGGSPYVAAKINEAKDLLETTTKH

SEQ ID NO: 9965 - protein, 595 aa, Artificial Sequence
  Description of Artificial Sequence: Synthetic coding sequence
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSRFL

SEQ ID NO: 9966 - protein, 782 aa, Artificial Sequence
  Description of Artificial Sequence: Synthetic coding sequence
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSSKIPKKGFVEVTELTDVTYTSNLVRLRPGHMNVVLILSNSTKTSLLQKFALEVYTFTGSSCLHFSFLSLDKHREWLEYLLEFAQDAAPIPNQYDKHFMERDYTGYVLALNGHKKYFCLFKPQKTVEEEEAIGSCSDVDSSLYLGESRGKPSCGLGSRPIKGKLSKLSLWMERLLEGSLQRFYIPSWPELD

SEQ ID NO: 9967 - protein, 655 aa, Artificial Sequence
  Description of Artificial Sequence: Synthetic coding sequence
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSSKIPKKGFVEVTELTDVTYTSNLVRLRPGHMNVVLILSNSTKTSLLQKFALEVYTFTGKIIRW

SEQ ID NO: 9968 - protein, 595 aa, Artificial Sequence; identical to SEQ ID NO: 9965
  Description of Artificial Sequence: Synthetic coding sequence

SEQ ID NO: 9969 - protein, 358 aa, Artificial Sequence
  Description of Artificial Sequence: Synthetic coding sequence
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPEELFNVFFGGHFPTGNIHMFSNVTDDTYYYRRRHRHERTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQKSELTNLAGLYRDERLKQKAESLKLENCEKLSKLIGLRRGG

SEQ ID NO: 9970 - protein, 25 aa, Artificial Sequence
  Description of Artificial Sequence: Synthetic coding sequence
MAATLGSGERWTEAYIDAVRRNKYP

SEQ ID NO: 9971 - protein, 173 aa, Artificial Sequence
  Description of Artificial Sequence: Synthetic coding sequence
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPE

SEQ ID NO: 9972 - protein, 181 aa, Artificial Sequence
  Description of Artificial Sequence: Synthetic coding sequence
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPEELFNVFFG

SEQ ID NO: 9973 - protein, 341 aa, Artificial Sequence
  Description of Artificial Sequence: Synthetic coding sequence
MAKGLLVTYALWAVGGPAGLHHLYLGRDSHALLWMLTLGGGGLGWLWEFWKLPSFVAQANRAQGQRQSPRGVTPPLSPIRFAAQVIVGIYFGLVALISLSSMVNFYIVALPLAVGLGVLLVAAVGNQTSDFKNTLGSAFLTSPIFYGRPIAILPISVAASITAQRHRRYKALVASEPLSVRLYRLGLAYLAFTGPLAYSALCNTAATLSYVAETFGSFLNWFSFFPLLGRLMEFVLLLPYRIWRLLMGETGFNSSCFQEWAKLYEFVHSFQDEKRQLAYQVLGLSEGATNEEIHRSYQELVKVWHPDHNLDQTEEAQRHFLEIQAAYEVLSQPRKPWGSRR

SEQ ID NO: 9974 - protein, 341 aa, Artificial Sequence; identical to SEQ ID NO: 9973
  Description of Artificial Sequence: Synthetic coding sequence

SEQ ID NO: 9975 - protein, 226 aa, Artificial Sequence
  Description of Artificial Sequence: Synthetic coding sequence
MAAMRWRWWQRLLPWRLLQARGFPQNSAPSLGLGARTYSQGDCSYSRTALYDLLGVPSTATQAQIKAAYYRQCFLYHPDRNSGSAEAAERFTRISQAYVVLGSATLRRKYDRGLLSDEDLRGPGVRPSRTPAPDPGSPRTPPPTSRTHDGSRASPGANRTMFNFDAFYQAHYGEQLERERRLRARREALRKRQEYRSMKGLRWEDTRDTAAIFLIFSIFIIIGFYI

SEQ ID NO: 9976 - protein, 173 aa, Artificial Sequence
  Description of Artificial Sequence: Synthetic coding sequence
MRWRWWQRLLPWRLLQARGFPQNSAPSLGLGARTYSQGDCSYSRTALYDLLGVPSTATQAQIKAAYYRQCFLYHPDRNSGSAEAAERFTRISQAYVVLGSATLRRKYDRGLLSDEDLRGPGVRPSRTPAPDPGSPRTPPPTSRSMKGLRWEDTRDTAAIFLIFSIFIIIGFYI

SEQ ID NO: 9977 - protein, 241 aa, Artificial Sequence
  Description of Artificial Sequence: Synthetic coding sequence
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 9978 - protein, 178 aa, Artificial Sequence
  Description of Artificial Sequence: Synthetic coding sequence
MLRTALRGAPRLLSRVQPRAPCLRRLWGRGARPEVAGRRRAWAWGWRRSSSEQGPGPAAALGRVEAAHYQLVYTCKVCGTRSSKRISKLAYHQGVVIVTCPGCQNHHIIADNLGWFSDLNGKRNIEEILTARGEQVHRVAGEGALELVLEAAGAPTSTAAPEAGEDEGPPSPGKTEPS

SEQ ID NO: 9979 - protein, 538 aa, Artificial Sequence
  Description of Artificial Sequence: Synthetic coding sequence
MTRECPSPAPGPGAPLSGSVLAEAAVVFAVVLSIHATVWDRYSWCAVALAVQAFYVQYKWDRLLQQGSAVFQFRMSANSGLLPASMVMPLLGLVMKERCQTAGNPFFERFGIVVAATGMAVALFSSVLALGITRPVPTNTCVILGLAGGVIIYIMKHSLSVGEVIEVLEVLLIFVYLNMILLYLLPRCFTPGEALLVLGGISFVLNQLIKRSLTLVESQGDPVDFFLLVVVVGMVLMGIFFSTLFVFMDSGTWASSIFFHLMTCVLSLGVVLPWLHRLIRRNPLLWLLQFLFQTDTRIYLLAYWSLLATLACLVVLYQNAKRSSSESKKHQAPTIARKYFHLIVVATYIPGIIFDRPLLYVAATVCLAVFIFLEYVRYFRIKPLGHTLRSFLSLFLDERDSGPLILTHIYLLLGMSLPIWLIPRPCTQKGSLGGARALVPYAGVLAVGVGDTVASIFGSTMGEIRWPGTKKTFEGTMTSIFAQIISVALILIFDSGVDLNYSYAWILGSISTVSLLEAYTTQIDNLLLPLYLLILLMA

SEQ ID NO: 9980 - protein, 266 aa, Artificial Sequence
  Description of Artificial Sequence: Synthetic coding sequence
MTRECPSPAPGPGAPLSGSVLAEAAVVFAVVLSIHATVWDRYSWCAVALAVQAFYVQYKWDRLLQQGSAVFQFRMSANSGLLPASMVMPLLGLVMKERCQTAGNPFFERFGIVVAATGMAVALFSSVLALGITRPVPTNTCVILGLAGGVIIYIMKHSLSVGEVIEVLEVLLIFVYLNMILLYLLPRCFTPGEALLVLGGISFVLNQLIKRSLTLVESQGDPVDFFLLVVVVGMVLMGIFFSTLFVFMDSGTRPPPSPESISTSLW

SEQ ID NO: 9981 - protein, 238 aa, Artificial Sequence
  Description of Artificial Sequence: Synthetic coding sequence
MAADGQCSLPASWRPVTLTHVEYPAGDLSGHLLAYLSLSPVFVIVGFVTLIIFKRELHTISFLGGLALNEGVNWLIKNVIQEPRPCGGPHTAVGTKYGMPSSHSQFMWFFSVYSFLFLYLRMHQTNNARFLDLLWRHVLSLGLLAVAFLVSYSRVYLLYHTWSQVLYGGIAGGLMAIAWFIFTQEVLTPLFPRIAAWPVSEFFLIRDTSLIPNVLWFEYTVTRAEARNRQRKLGTKLQ

SEQ ID NO: 9982 - protein, 195 aa, Artificial Sequence
  Description of Artificial Sequence: Synthetic coding sequence
MAADGQCSLPASWRPVTLTHVEYPAGDLSGHLLAYLSLSPVFVIVGFVTLIIFKRELHTISFLGGLALNEGVNWLIKNVIQEPRPCGGPHTAVGTKYGMPSSHSQFMWFFSVYSFLFLYLRMHQTNNARFLDLLWRHVLSLGLLAVAFLVSYSRPVSEFFLIRDTSLIPNVLWFEYTVTRAEARNRQRKLGTKLQ

SEQ ID NO: 9983 - protein, 97 aa, Artificial Sequence
  Description of Artificial Sequence: Synthetic coding sequence
MPSSHSQFMWFFSVYSFLFLYLRMHQTNNARFLDLLWRHVLSLGLLAVAFLVSYSRPVSEFFLIRDTSLIPNVLWFEYTVTRAEARNRQRKLGTKLQ

SEQ ID NO: 9984 - protein, 408 aa, Artificial Sequence
  Description of Artificial Sequence: Synthetic coding sequence
MWAFSELPMPLLINLIVSLLGFVATVTLIPAFRGHFIAARLCGQDLNKTSRQQIPESQGVISGAVFLIILFCFIPFPFLNCFVKEQCKAFPHHEFVALIGALLAICCMIFLGFADDVLNLRWRHKLLLPTAASLPLLMVYFTNFGNTTIVVPKPFRPILGLHLDLGILYYVYMGLLAVFCTNAINILAGINGLEAGQSLVISASIIVFNLVELEGDCRDDHVFSLYFMIPFFFTTLGLLYHNWYPSRVFVGDTFCYFAGMTFAVVGILGHFSKTMLLFFMPQVFNFLYSLPQLLHIIPCPRHRIPRLNIKTGKLEMSYSKFKTKSLSFLGTFILKVAESLQLVTVHQSETEDGEFTECNNMTLINLLLKVLGPIHERNLTLLLLLLQILGSAITFSIRYQLVRLFYDV

SEQ ID NO: 9985 - protein, 408 aa, Artificial Sequence; identical to SEQ ID NO: 9984
  Description of Artificial Sequence: Synthetic coding sequence

SEQ ID NO: 9986 - protein, 327 aa, Artificial Sequence
  Description of Artificial Sequence: Synthetic coding sequence
MIFLGFADDVLNLRWRHKLLLPTAASLPLLMVYFTNFGNTTIVVPKPFRPILGLHLDLGILYYVYMGLLAVFCTNAINILAGINGLEAGQSLVISASIIVFNLVELEGDCRDDHVFSLYFMIPFFFTTLGLLYHNWYPSRVFVGDTFCYFAGMTFAVVGILGHFSKTMLLFFMPQVFNFLYSLPQLLHIIPCPRHRIPRLNIKTGKLEMSYSKFKTKSLSFLGTFILKVAESLQLVTVHQSETEDGEFTECNNMTLINLLLKVLGPIHERNLTLLLLLLQVRMGIEFIPPCLPFCVILTPVHFSLQILGSAITFSIRYQLVRLFYDV

SEQ ID NO: 9987 - protein, 84 aa, Artificial Sequence
  Description of Artificial Sequence: Synthetic coding sequence
MATGTDQVVGLGLVAVSLIIFTYYTAWVILLPFIDSQHVIHKYFLPRAYAVAIPLAAGLLLLLFVGLFISYVMLKTKRVTKKAQ

SEQ ID NO: 9988 - protein, 130 aa, Artificial Sequence
  Description of Artificial Sequence: Synthetic coding sequence
MATGTDQVVGLGLVAVSLIIFTYYTAWVILLPFIDSQHVIHKYFLPRAYAVAIPLAAGLLLLLFVGKSSPPPLDPGQGFGKTPPLNMLPHFGGAGSCLPRTHPWGFPVHPSRLPVSNLWVSWCPRLFGLQ

SEQ ID NO: 9989 - protein, 2369 aa, Artificial Sequence
  Description of Artificial Sequence: Synthetic coding sequence
MNTEELELLSDSKYRNYVAAIDKALKNFEYSSEWADLISALGKLNKVLQNNAKYQVVPKKLTIGKRLAQCLHPALPGGVHRKALETYEIIFKIIGPKRLAKDLFLYSSGLFPLLANAAMSVKPTLLSLYEIYYLPLGKTLKPGLQGLLTGILPGLEEGSEYYERTNMLLEKVAAAVDQSAFYSALWGSLLTSPAVRLPGITYVLAHLNRKLSMEDQLYIIGSDIELMVEAVSTSVQDSSVLVQRSTLDLILFCFPFHMSQATRPDMIRILSAALHVVLRRDMSLNRRLYAWLLGPRSTRHSNPEEHATYYFTTFSKELLVQAMVGILQVNGFGEENTLMQDLKPFRILISLLDKPELGPVILEDVLIEVFRTLYSQCKAELDLQTEPPFSKDHAQLSSKLRENKKTAELIKTANLLFNSFEPYYMWDYVARWFEECCRRTLHVRLQIGPGDSNDSSELQLTNFCLLVDFLLDIVSLETYIEIQTEHLPQLLLRMISALTSHLQTLHLSELTDSLRLCSKILSKVQPPLLSASTGGVLQFPSGQNNSVKEWEDKKVSSVSHENPTEVFEDGENPPSSRSSESGFTEFIQYQADRTDDIDRELSEGQGAAAIPIGSTSSETETASTVGSEETIIQTPSVVTQGTATRSRKTAQKTAMQCCLEYVQQFLTRLINLYIIQNNSFSQSLATEHQGDLGREQGETSKWDRNSQGDVKEKNISKQKTSKEYLSAFLAACQLFLECSSFPVYIAEGNHTSELRSEKLETDCEHVQPPQWLQTLMNACSQASDFSVQSVAISLVMDLVGLTQSVAMVTGENINSVEPAQPLSPNQGRVAVVIRPPLTQGNLRYIAEKTEFFKHVALTLWDQLGDGTPQHHQKSVELFYQLHNLVPSSSICEDVISQQLTHKDKKIRMEAHAKFAVLWHLTRDLHINKSSSFVRSFDRSLFIMLDSLNSLDGSTSSVGQAWLNQVLQRHDIARVLEPLLLLLLHPKTQRVSVQRVQAERYWNKSPCYPGEESDKHFMQNFACSNVSQVQLITSKGNGEKPLTMDEIENFSLTVNPLSDRLSLLSTSSETIPMVVSDFDLPDQQIEILQSSDSGCSQSSAGDNLSYEVDPETVNAQEDSQMPKESSPDDDVQQVVFDLICKVVSGLEVESASVTSQLEIEAMPPKCSDIDPDEETIKIEDDSIQQSQNALLSNESSQFLSVSAEGGHECVANGISRNSSSPCISGTTHTLHDSSVASIETKSRQRSHSSIQFSFKEKLSEKVSEKETIVKESGKQPGAKPKVKLARKKDDDKKKSSNEKLKQTSVFFSDGLDLENWYSCGEGDISEIESDMGSPGSRKSPNFNIHPLYQHVLLYLQLYDSSRTLYAFSAIKAILKTNPIAFVNAISTTSVNNAYTPQLSLLQNLLARHRISVMGKDFYSHIPVDSNHNFRSSMYIEILISLCLYYMRSHYPTHVKVTAQDLIGNRNMQMMSIEILTLLFTELAKVIESSAKGFPSFISDMLSKCKVQKVILHCLLSSIFSAQKWHSEKMAGKNLVAVEEGFSEDSLINFSEDEFDNGSTLQSQLLKVLQRLIVLEHRVMTIPEENETGFDFVVSDLEHISPHQPMTSLQYLHAQPITCQGMFLCAVIRALHQHCACKMHPQWIGLITSTLPYMGKVLQRVVVSVTLQLCRNLDNLIQQYKYETGLSDSRPLWMASIIPPDMILTLLEGITAIIHYCLLDPTTQYHQLLVSVDQKHLFEARSGILSILHMIMSSVTLLWSILHQADSSEKMTIAASASLTTINLGATKNLRQQILELLGPISMNHGVHFMAAIAFVWNERRQNKTTTRTKVIPAASEEQLLLVELVRSISVMRAETVIQTVKEVLKQPPAIAKDKKHLSLEVCMLQFFYAYIQRVLNEFIMKNPSLENKKDQRDLQDVTHKIVDAIGAIAGSSLEQTTWLRRNLEVKPSPKIMVDGTNLESDVEGILVKHLGLLSVLAHLLDMVFYSDEKERVIPLLVNIMHYVVPYLRNHSAHNAPSYRACVQLLSSLSGYQYTRRAWKKEAFDLFMDPSFFQMDASCVNHWRAIMDNLMTHDKTTFRDLMTRVAVAQSSSLNLFANRDVELEQRAMLLKRLAFAIFSSEIDQYQKYLPDIQGIPVSKWVQLLTALSPAYRTSGPSVAGLETTYTGGNGFSTSYNSQRWLNLYLSACKFLDLALALPSENLPQFQMYRWAFIPEASDDSGLEVRRQGIHQREFKPYVVRLAKLLRKRAKDKEEDFKTVILEGLEMAKHQKNPEEDNSGRTLGWEPGHLLLTICTVRSMEQLLPFFNVLSQVFNSKVTSRCGGHSGSPILYSNAFPNKDMKLENHKPCSSKARQKIEEMVEKDFLEGMIKT

SEQ ID NO: 9990 - protein, 2465 aa, Artificial Sequence
  Description of Artificial Sequence: Synthetic coding sequence
MNTEELELLSDSKYRNYVAAIDKALKNFEYSSEWADLISALGKLNKVLQNNAKYQVVPKKLTIGKRLAQCLHPALPGGVHRKALETYEIIFKIIGPKRLAKDLFLYSSGLFPLLANAAMSVKPTLLSLYEIYYLPLGKTLKPGLQGLLTGILPGLEEGSEYYERTNMLLEKVAAAVDQSAFYSALWGSLLTSPAVRLPGITYVLAHLNRKLSMEDQLYIIGSDIELMVEAVSTSVQDSSVLVQRSTLDLILFCFPFHMSQATRPDMIRILSAALHVVLRRDMSLNRRLYAWLLGFDNNGAIIGPRSTRHSNPEEHATYYFTTFSKELLVQAMVGILQVNGFGEENTLMQDLKPFRILISLLDKPELGPVILEDVLIEVFRTLYSQCKAELDLQTEPPFSKDHAQLSSKLRENKKTAELIKTANLLFNSFEPYYMWDYVARWFEECCRRTLHVRLQIGPGDSNDSSELQLTNFCLLVDFLLDIVSLPTRSMRVLCQETYIEIQTEHLPQLLLRMISALTSHLQTLHLSELTDSLRLCSKILSKVQPPLLSASTGGVLQFPSGQNNSVKEWEDKKVSSVSHENPTEVFEDGENPPSSRSSESGFTEFIQYQADRTDDIDRELSEGQGAAAIPIGSTSSETETASTVGSEETIIQTPSVVTQGTATRSRKTAQKTAMQCCLEYVQQFLTRLINLYIIQNNSFSQSLATEHQGDLGREQGETSKWDRNSQGDVKEKNISKQKTSKEYLSAFLAACQLFLECSSFPVYIAEGNHTSELRSEKLETDCEHVQPPQWLQTLMNACSQASDFSVQSVAISLVMDLVGLTQSVAMVTGENINSVEPAQPLSPNQGRVAVVIRPPLTQGNLRYIAEKTEFFKHVALTLWDQLGDGTPQHHQKSVELFYQLHNLVPSSSICEDVISQQLTHKDKKIRMEAHAKFAVLWHLTRDLHINKSSSFVRSFDRSLFIMLDSLNSLDGSTSSVGQAWLNQVLQRHDIARVLEPLLLLLLHPKTQRVSVQRVQAERYWNKSPCYPGEESDKHFMQNFACSNVSQVQLITSKGNGEKPLTMDEIENFSLTVNPLSDRLSLLSTSSETIPMVVSDFDLPDQQIEILQSSDSGCSQSSAGDNLSYEVDPETVNAQEDSQMPKESSPDDDVQQVVFDLICKVVSGLEVESASVTSQLEIEAMPPKCSDIDPDEETIKIEDDSIQQSQNALLSNESSQFLSVSAEGGHECVANGISRNSSSPCISGTTHTLHDSSVASIETKSRQRSHSSIQFSFKEKLSEKVSEKETIVKESGKQPGAKPKVKLARKKDDDKKKSSNEKLKQTSVFFSDGLDLENWYSCGEGDISEIESDMGSPGSRKSPNFNIHPLYQHVLLYLQLYDSSRTLYAFSAIKAILKTNPIAFVNAISTTSVNNAYTPQLSLLQNLLARHRISVMGKDFYSHIPVDSNHNFRSSMYIEILISLCLYYMRSHYPTHVKVTAQDLIGNRNMQMMSIEILTLLFTELAKVIESSAKGFPSFISDMLSKCKVQKVILHCLLSSIFSAQKWHSEKMAGKNLVAVEEGFSEDSLINFSEDEFDNGSTLQSQLLKVLQRLIVLEHRVMTIPEENETGFDFVVSDLEHISPHQPMTSLQYLHAQPITCQGMFLCAVIRALHQHCACKMHPQWIGLITSTLPYMGKVLQRVVVSVTLQLCRNLDNLIQQYKYETGLSDSRPLWMASIIPPDMILTLLEGITAIIHYCLLDPTTQYHQLLVSVDQKHLFEARSGILSILHMIMSSVTLLWSILHQADSSEKMTIAASASLTTINLGATKNLRQQILELLGPISMNHGVHFMAAIAFVWNERRQNKTTTRTKVIPAASEEQLLLVELVRSISVMRAETVIQTVKEVLKQPPAIAKDKKHLSLEVCMLQFFYAYIQRIPVPNLVDSWASLLILLKDSIQLSLPAPGQFLILGVLNEFIMKNPSLENKKDQRDLQDVTHKIVDAIGAIAGSSLEQTTWLRRNLEVKPSPKIMVDGTNLESDVEDMLSPAMETANITPSVYSVHALTLLSEVLAHLLDMVFYSDEKERVIPLLVNIMHYVVPYLRNHSAHNAPSYRACVQLLSSLSGYQYTRRAWKKEAFDLFMDPSFFQMDASCVNHWRAIMDNLMTHDKTTFRDLMTRVAVAQSSSLNLFANRDVELEQRAMLLKRLAFAIFSSEIDQYQKYLPDIQERLVESLRLPQVPTLHSQVFLFFRVLLLRMSPQHLTSLWPTMITELVQVFLLMEQELTADEDISRTSGPSVAGLETTYTGGNGFSTSYNSQRWLNLYLSACKFLDLALALPSENLPQFQMYRWAFIPEASDDSGLEVRRQGIHQREFKPYVVRLAKLLRKRAKKNPEEDNSGRTLGWEPGHLLLTICTVRSMEQLLPFFNVLSQVFNSKVTSRCGGHSGSPILYSNAFPNKDMKLENHKPCSSKARQKIEEMVEKDFLEGMIKT

SEQ ID NO: 9991 - protein, 2369 aa, Artificial Sequence; identical to SEQ ID NO: 9989
  Description of Artificial Sequence: Synthetic coding sequence

SEQ ID NO: 9992 - protein, 229 aa, Artificial Sequence [sequence omitted]

SEQ ID NO: 9993 - protein, 140 aa, Artificial Sequence
  Description of Artificial Sequence: Synthetic coding sequence
MQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 9994 - protein, 482 aa, Artificial Sequence
  Description of Artificial Sequence: Synthetic coding sequence
MPPSPLDDRVVVALSRPVRPQDLNLCLDSSYLGSANPGSNSHPPVIATTVVSLKAANLTYMPSSSGSARSLNCGCSSASCCTVATYDKDNQAQTQAIAAGTTTTAIGTSTTCPANQMVNNNENTGSLSPSSGVGSPVSGTPKQLASIKIIYPNDLAKKMTKCSKSHLPSQGPVIIDCRPFMEYNKSHIQGAVHINCADKISRRRLQQGKITVLDLISCREGKDSFKRIFSKEIIVYDENTNEPSRVMPSQPLHIVLESLKREGKEPLVLKGGLSSFKQNHENLCDNSLQLQECREVGGGASAASSLLPQPIPTTPDIENAELTPILPFLFLGNEQDAQDLDTMQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 9995 - protein, 427 aa, Artificial Sequence
  Description of Artificial Sequence: Synthetic coding sequence
MPPSPLDDRVVVALSRPVRPQDLNLCLDSSYLGSANPGSNSHPPVITTTAIGTSTTCPANQMVNNNENTGSLSPSSGVGSPVSGTPKQLASIKIIYPNDLAKKMTKCSKSHLPSQGPVIIDCRPFMEYNKSHIQGAVHINCADKISRRRLQQGKITVLDLISCREGKDSFKRIFSKEIIVYDENTNEPSRVMPSQPLHIVLESLKREGKEPLVLKGGLSSFKQNHENLCDNSLQLQECREVGGGASAASSLLPQPIPTTPDIENAELTPILPFLFLGNEQDAQDLDTMQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 9996 - protein, 140 aa, Artificial Sequence; identical to SEQ ID NO: 9993
  Description of Artificial Sequence: Synthetic coding sequence

SEQ ID NO: 9997 - protein, 295 aa, Artificial Sequence
  Description of Artificial Sequence: Synthetic coding sequence
MTEGVLPGLYLGNFIDAKDLDQLGRNKITHIISIHESPQPLLQDITYLRIPVADTPEVPIKKHFKECINFIHCCRLNGGNCLVHCFAGISRSTTIVTAYVMTVTGLGWRDVLEAIKATRPIANPNPGFRQQLEEFGWASSQKGARHRTSKTSGAQCPPMTSATCLLAARVALLSAALVREATGRTAQRCRLSPRAAAERLLGPPPHVAAGWSPDPKYQICLCFGEEDPGPTQHPKEQLIMADVQVQLRPGSSSCTLSASTERPDGSSTPGNPDGITHLQCSCLHPKRAASSSCTR

SEQ ID NO: 9998 - protein, 235 aa, Artificial Sequence
  Description of Artificial Sequence: Synthetic coding sequence
MGNGMTKVLPGLYLGNFIDAKDLDQLGRNKITHIISIHESPQPLLQDITYLRIPVADTPEVPIKKHFKECINFIHCCRLNGGNCLVHCFAGISRSTTIVTAYVMTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 9999 - protein, 87 aa, Artificial Sequence
  Description of Artificial Sequence: Synthetic coding sequence
MGNGMTKMPKTWISWAEIRSHTSSLSMSHPSLCCRISPTFASRSLIPLRYPSKSTSKNVSTSSTAAALMGGTALCTALQASLAAPRL

SEQ ID NO: 10000 - protein, 232 aa, Artificial Sequence
  Description of Artificial Sequence: Synthetic coding sequence
MTEGVLPGLYLGNFIDAKDLDQLGRNKITHIISIHESPQPLLQDITYLRIPVADTPEVPIKKHFKECINFIHCCRLNGGNCLVHCFAGISRSTTIVTAYVMTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 10001 - protein, 132 aa, Artificial Sequence
  Description of Artificial Sequence: Synthetic coding sequence
MTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 10002 - protein, 132 aa, Artificial Sequence; identical to SEQ ID NO: 10001
  Description of Artificial Sequence: Synthetic coding sequence

SEQ ID NO: 10003 - protein, 93 aa, Artificial Sequence
  Description of Artificial Sequence: Synthetic coding sequence
  MOD_RES (1)..(1): Any amino acid
XTRLPPGGWSPDPKYQICLCFGEEDPGPTQHPKEQLIMADVQVQLRPGSSSCTLSASTERPDGSSTPGNPDGITHLQCSCLHPKRAASSSCTR

SEQ ID NO: 10004 - protein, 132 aa, Artificial Sequence; identical to SEQ ID NO: 10001
  Description of Artificial Sequence: Synthetic coding sequence

SEQ ID NO: 10005 - protein, 837 aa, Artificial Sequence
  Description of Artificial Sequence: Synthetic coding sequence
MAKAAASSSLEDLDLSGEEVQRLTSAFQDPEFRRMFSQYAEELTDPENRRRYEAEITALERERGVEVRFVHPEPGHVLRTSLDGARRCFVNVCSNALVGAPSSRPGSGGDRGAAPGSHWSLPYSLAPGREYAGRSSSRYMVYDVVFHPDALALARRHEGFRQMLDATALEAVEKQFGVKLDRRNAKTLKAKYKGTPEAAVLRTPLPGVIPARPDGEPKGPLPDFPYPYQYPAAPGPRAPSPPEAALQPAPTEPRYSVVQRHHVDLQDYRCSRDSAPSPVPHELVITIELPLLRSAEQAALEVTRKLLCLDSRKPDYRLRLSLPYPVDDGRGKAQFNKARRQLVVTLPVVLPAARREPAVAVAAAAPEESADRSGTDGQACASAREGEAGPARSRAEDGGHDTCVAGAAGSGVTTLGDPEVAPPPAAAGEERVPKPGEQDLSRHAGSPPGSVEEPSPGGENSPGGGGSPCLSSRSLAWGSSAGRESARGDSSVETREESEGTGGQRSACAMGGPGTKSGEPLCPPLLCNQDKETLTLLIQVPRIQPQSLQGDLNPLWYKLRFSAQDLVYSFFLQFAPENKLSTTEPVISISSNNAVIELAKSPESHGHWREWYYGVNNDSLEERLFVNEENVNEFLEEVLSSPFKQSMSLTPPLIEVLQVTDNKIQINAKLQECSNSDQLQGKEERVNEESHLTEKEYIEHCNTPTTDSDSSIAVKALQIDSFGLVTCFQQESLDVSQMILGKSQQPESKMQSEFIKEKSATCSNEEKDNLNESVITEEKETDGDHLSSLLNKTTVHNIPGFDSIKETNMQDGSVQVIKDHVTNCAFSFQNSLLYDLD

SEQ ID NO: 10006 - protein, 789 aa, Artificial Sequence
  Description of Artificial Sequence: Synthetic coding sequence
MAKAAASSSLEDLDLSGEEVQRLTSAFQDPEFRRMFSQYAEELTDPENRRRYEAEITALERERGVEVRFVHPEPGHVLRTSLDGARRCFVNVCSNALVGAPSSRPGSGGDRGAAPGSHWSLPYSLAPGREYAGRSSSRYMVYDVVFHPDALALARRHEGFRQMLDATALEAVEKQFGVKLDRRNAKTLKAKYKGTPEAAVLRTPLPGVIPARPDGEPKGPLPDFPYPYQYPAAPGPRAPSPPEAALQPAPTEPRYSVVQRHHVDLQDYRCSRDSAPSPVPHELVITIELPLLRSAEQAALEVTRKLLCLDSRKPDYRLRLSLPYPVDDGRGKAQFNKARRQLVVTLPVVLPAARREPAVAVAAAAPEESADRSGTDGQACASAREGEAGPARSRAEDGGHDTCVAGAAGSGVTTLGDPEVAPPPAAAGEERVPKPGEQDLSRHAGSPPGSVEEPSPGGENSPGGGGSPCLSSRSLAWGSSAGRESARGDSSVETREESEGTGGQRSACAMGGPGTKSGEPLCPPLLCNQDKETLTLLIQVPRIQPQSLQGDLNPLWYKLRFSAQDLVYSFFLQFAPENKLSTTEPVISISSNNAVIELAKSPESHGHWREWYYGVNNDSLELQECSNSDQLQGKEERVNEESHLTEKEYIEHCNTPTTDSDSSIAVKALQIDSFGLVTCFQQESLDVSQMILGKSQQPESKMQSEFIKEKSATCSNEEKDNLNESVITEEKETDGDHLSSLLNKTTVHNIPGFDSIKETNMQDGSVQVIKDHVTNCAFSFQNSLLYDLD

SEQ ID NO: 10007 - protein, 105 aa, Artificial Sequence
  Description of Artificial Sequence: Synthetic coding sequence
MGETEGKKDEADYKRLQTFPLVRHSDMPEEMRVETMELCVTACEKFSNNNESAAKMIKETMDKKFGSSWHVVIGEGFGFEITHEVKNLLYLYFGGTLAVCVWKCS

SEQ ID NO: 10008 - protein, 523 aa, Artificial Sequence
  Description of Artificial Sequence: Synthetic coding sequence
MAAVGRVGSFGSSPPGLSSTYTGGPLGNEIASGNGGAAAGDDEDGQNLWSCILSEVSTRSRSKLPAGKNVLLLGEDGAGKTSLIRKIQGIEEYKKGRGLEYLYLNVHDEDRDDQTRCNVWILDGDLYHKGLLKFSLDAVSLKDTLVMLVVDMSKPWTALDSLQKWASVVREHVDKLKIPPEEMKQMEQKLIRDFQEYVEPGEDFPASPQRRNTASQEDKDDSVVLPLGADTLTHNLGIPVLVVCTKCDAISVLEKEHDYRDEHFDFIQSHIRKFCLQYGAALIYTSVKENKNIDLVYKYIVQKLYGFPYKIPAVVVEKDAVFIPAGWDNDKKIGILHENFQTLKAEDNFEDIITKPPVRKFVHEKEIMAEDDQVFLMKLQSLLAKQPPTAAGRPVDASPRVPGGSPRTPNRSVSSNVASVSPIPAGSKKIDPNMKAGATSEGVLANFFNSLLSKKTGSPGGPGVSGGSPAGGAGGGSSGLPPSTKKSGQKPVLDVHAELDRITRKPVTVSPTTPTSPTEGEAS

SEQ ID NO: 10009 - protein, 116 aa, Artificial Sequence
  Description of Artificial Sequence: Synthetic coding sequence
MEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 10010 - protein, 152 aa, Artificial Sequence
  Description of Artificial Sequence: Synthetic coding sequence
MEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCGVLLCRPGWSAVMQFRLTATSASQVQVILLPQPPEYLELQAHAITPG

SEQ ID NO: 10011 - protein, 122 aa, Artificial Sequence
  Description of Artificial Sequence: Synthetic coding sequence
MARSLGVLVALPFPLPVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 10012 - protein, 578 aa, Artificial Sequence
  Description of Artificial Sequence: Synthetic coding sequence
MDPDKQDALNSIENSIYRTAFKLQSVQTLCQLDLIDSSLIQQVLLRPSFWEARKHSLSVQQLSQALQELFQKAREENPGQVHPRAPELTLSLLTTMYNSKGTGFLQLMPAAAALITLSGDSPLSKYRALFQLYAENSRGGYDSGPRMTRRVLRKLLTDLQQIPTFVGESRALCPVESATRSCFQGVLSPAIKEEKFLSWVQSEPPILLWLPTCHRLSAAERVTHPARCTLCRTFPITGLRYRCLKCLNFDICQMCFLSGLHSKSHQKSHPVIEHCIQMSAMQNTKLLFRTLRNNLLQGRCRKKEAARRQQLLDQVNPKGVPHHAQARLLKKQLNQYKDKLQAIYTSQEERICRFETRIHKLKTNQDSLWTKLQQIRRDLQARLQPPGPSSSSFQNVGNKVDHSSTEKVPKGGDYLQIKNATEDASTGEPLPKLDEVDRSHRSHTNAEHALRNPESPETTLHSTRAQSQTQKMPQKVISALPSYQEGLKQDIPKMVPAEMSSPALAAVEKKEAGNIKERKDELEEEELQELLSKLMDAFNLETPSGPESSVNMDLYSGAQRVCRAFSALVDQIALPNLK

SEQ ID NO: 10013 - protein, 285 aa, Artificial Sequence
  Description of Artificial Sequence: Synthetic coding sequence
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVQVTKKKKKKQHKIPTNDELLYDPEKDNRDQAWVDAQRRGYHGLGPQRSRQQQPVPNSDAVLNCPACMTTLCLDCQRHESYKTQYRAMFVMNCSINKEEVLRYKASENRKKRRVHKKMRSNREDAAEKAETDVEEIYHPVMCTECSTEVAVYDKDEVFHFFNVLASHS

SEQ ID NO: 10014 - protein, 1411 aa, Artificial Sequence
  Description of Artificial Sequence: Synthetic coding sequence
MLRRILQRTPGRVGSQGSDLDSSATPINTVDVNNESSSEGFICPQCMKSLGSADELFKHYEAVHDAGNDSGHGGESNLALKRDDVTLLRQEVQDLQASLKEEKWYSEELKKELEKYQGLQQQEAKPDGLVTDSSAELQSLEQQLEEAQTENFNIKQMKDLFEQKAAQLATEIADIKSKYDEERSLREAAEQKVTRLTEELNKEATVIQDLKTELLQRPGIEDVAVLKKELVQVQTLMDNMTLERERESEKLKDECKKLQSQYASSEATISQLRSELAKGPQEVAVYVQELQKLKSSVNELTQKNQTLTENLLKKEQDYTKLEEKHNEESVSKKNIQATLHQKDLDCQQLQSRLSASETSLHRIHVELSEKGEATQKLKEELSEVETKYQHLKAEFKQLQQQREEKEQHGLQLQSEINQLHSKLLETERQLGEAHGRLKEQRQLSSEKLMDKEQQVADLQLKLSRLEEQLKEKVTNSTELQHQLDKTKQQHQEQQALQQSTTAKLREAQNDLEQVLRQIGDKDQKIQNLEALLQKSKENISLLEKEREDLYAKIQAGEGETAVLNQLQEKNHTLQEQVTQLTEKLKNQSESHKQAQENLHDQVQEQKAHLRAAQDRVLSLETSVNELNSQLNESKEKVSQLDIQIKAKTELLLSAEAAKTAQRADLQNHLDTAQNALQDKQQELNKITTQLDQVTAKLQDKQEHCSQLESHLKEYKEKYLSLEQKTEELEGQIKKLEADSLEVKASKEQALQDLQQQRQLNTDLELRATELSKQLEMEKEIVSSTRLDLQKKSEALESIKQKLTKQEEEKKILKQDFETLSQETKIQHEELNNRIQTTVTELQKVKMEKEALMTELSTVKDKLSKVSDSLKNSKSEFEKENQKGKAAILDLEKTCKELKHQLQVQMENTLKEQKELKKSLEKEKEASHQLKLELNSMQEQLIQAQNTLKQNEKEEQQLQGNINELKQSSEQKKKQIEALQGELKIAVLQKTELENKLQQQLTQAAQELAAEKEKISVLQNNYEKSQETFKQLQSDFYGRESELLATRQDLKSVEEKLSLAQEDLISNRNQIGNQNKLIQELKTAKATLEQDSAKKEQQLQERCKALQDIQKEKSLKEKELVNEKSKLAEIEEIKCRQEKEITKLNEELKSHKLESIKEITNLKDAKQLLIQQKLELQGKADSLKAAVEQEKRNQQILKDQVKKEEEELKKEFIEKEAKLHSEIKEKEVGMKKHEENEAKLTMQITALNENLGTVKKEWQSSQRRVSELEKQTDDLRGEIAVLEATVQNNQDERRALLERCLKGEGEIEKLQTKVLELQRKLDNTTAAVQELGRENQSLQIKHTQALNRKWAEDNEVQNCMACGKGFSVTVRRHHCRQCGNIFCAECSAKNALTPSSKKPVRVCDACFNDLQG

SEQ ID NO: 10015 - protein, 310 aa, Artificial Sequence
  Description of Artificial Sequence: Synthetic coding sequence
LRRVDHETPGRVGSQGSDLDSSATPINTVDVNNESSSEGFICPQCMKSLGSADELFKHYEAVHDAGNDSGHGGESNLALKRDDVTLLRQEVQDLQASLKEEKWYSEELKKELEKYQGLQQQEAKPDGLVTDSSAELQSLEQQLEEAQTENFNIKQMKDLFEQKAAQLATEIADIKSKYDEERSLREAAEQKVTRLTEELNKEATVIQDLKTELLQRPGIEDVAVLKKELVQVQTLMDNMTLERERESEKLKDECKKLQSQYASSEATISQLRSELAKGPQEVAVYVQELQKLKSSVNELTQKNQKKKKKK

SEQ ID NO: 10016 - protein, 571 aa, Artificial Sequence
  Description of Artificial Sequence: Synthetic coding sequence
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRKIGMLIIPCSGGCPKLCCAVWQPPPYGATKHLQCAAWN

SEQ ID NO: 10017 - protein, 616 aa, Artificial Sequence
  Description of Artificial Sequence: Synthetic coding sequence
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTVSFASSQQEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRDIQQEAFRASHTHWRGVSFVYNHYLFSGCFLVVLLAILLYLLRLRRIHRRTPRSSSAAALWMEEGLPAQNAPGTL

SEQ ID NO: 10018 - protein, 608 aa, Artificial Sequence
  Description of Artificial Sequence: Synthetic coding sequence
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRDIQQEAFRASHTHWRGVSFVYNHYLFSGCFLVVLLAILLYLLRLRRIHRRTPRSSSAAALWMEEGLPAQNAPGTL

SEQ ID NO: 10019 - protein, 604 aa, Artificial Sequence
  Description of Artificial Sequence: Synthetic coding sequence
MARISFSYLCPASWYFTVPTVSPFLRQRVAFLGLFFISCLLLLMLIIDFRHWSASLPRDRQYERYLARVGELEATDTEDPNLNYGLVVDCGSSGSRIFVYFWPRHNGNPHDLLDIKQMRDRNSQPVVKKIKPGISAMADTPEHASDYLRPLLSFAAAHVPVKKHKETPLYILCTAGMRLLPERKQLAILADLVKDLPLEFDFLFSQSQAEVISGKQEGVYAWIGINFVLGRFDHEDESDAEATQELAAGRRRTVGILDMGGASLQIAYEVPTSTSVLPAKQEEAAKILLAEFNLGCDVQHTEHVYRVYVTTFLGFGGNFARQRYEDLVLNETLNKNRLLGQKTGLSPDNPFLDPCLPVGLTDVVERNSQVLHVRGRGDWVSCGAMLSPLLARSNTSQASLNGIYQSPIDFNNSEFYGFSEFFYCTEDVLRIGGRYHGPTFAKAAQDYCGMAWSVLTQRFKNGLFSSHADEHRLKYQCFKSAWMYQVLHEGFHFPYDYPNLRTAQLVYDREVQWTLGAILYKTRFLPLRDLRQEGVRQAHGSWFRLSFVYNHYLFFACILVVLLAIFLYLLRLRRIHHRQTRASAPLDLLWLEEVVPMMGVQVGP

SEQ ID NO: 10020 - protein, 458 aa, Artificial Sequence
  Description of Artificial Sequence: Synthetic coding sequence
MGLSRKEQVFLALLGASGVSGLTALILLLVEATSVLLPTDIKFGIVFDAGSSHTSLFLYQWLANKENGTGVVSQALACQVEGPGISSYTSNAAQAGESLQGCLEEALVLIPEAQHRKTPTFLGATAGMRLLSRKNSSQARDIFAAVTQVLGRSPVDFWGAELLAGQAEGAFGWITVNYGLGTLVKYSFTGEWIQPPEEMLVGALDMGGASTQITFVPGGPILDKSTQADFRLYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYVEASYPGQDRWLRDYCASGLYILTLLHEGYGFSEETWPSLEFRKQAGGVDIGWTLGYMLNLTGMIPADAPAQWRAESYGVWVAKVVFMVLALVAVVGAALVQLFWLQD

SEQ ID NO: 10021 - protein, 495 aa, Artificial Sequence
  Description of Artificial Sequence: Synthetic coding sequence
MGLSRKEQVFLALLGASGVSGLTALILLLVEATSVLLPTDIKFGIVFDAGSSHTSLFLYQWLANKENGTGVVSQALACQVEGPGISSYTSNAAQAGESLQGCLEEALVLIPEAQHRKTPTFLGATAGMRLLSRKNSSQARDIFAAVTQVLGRSPVDFWGAELLAGQAEGAFGWITVNYGLGTLVKYSFTGEWIQPPEEMLVGALDMGGASTQITFVPGGPILDKSTQADFRLYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYAFSNFYYTFHFLNLTSRQPLSTVNATIWEFCQRPWKLVEASYPGQDRWLRDYCASGLYILTLLHEGYGFSEETWPSLEFRKQAGGVDIGWTLGYMLNLTGMIPADAPAQWRAESYGVWVAKVVFMVLALVAVVGAALVQLFWLQD

SEQ ID NO: 10022 - protein, 495 aa, Artificial Sequence; identical to SEQ ID NO: 10021
  Description of Artificial Sequence: Synthetic coding sequence

SEQ ID NO: 10023 - protein, 453 aa, Artificial Sequence
  Description of Artificial Sequence: Synthetic coding sequence
MKLLVILLFSGLITGFRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQENRSSAAAMWPGTDVPIHDTISSYFMNYNSSVSFEERLNNITMWLNNSNPPVTFATLYWEEPDASGHKYGPEDKENMSRVLKKIDDLIGDLVQRLKMLGLWENLNVIITSDHGMTQCSQDRLINLDSCIDHSYYTLIDLSPVAAILPKINRTEVYNKLKNCSPHMNVYLKEDIPNRFYYQHNDRIQPIILVADEGWTIVLNESSQKLGDHGYDNSLPSMHPFLAAHGPAFHKGYKHSTINIVDIYPMMCHILGLKPHPNNGTFGHTKCLLVDQWCINLPEAIAIVIGSLLVLTMLTCLIIIMQNRLSVPRPFSRLQLQEDDDDPLIG

SEQ ID NO: 10024 - protein, 453 aa, Artificial Sequence; identical to SEQ ID NO: 10023
  Description of Artificial Sequence: Synthetic coding sequence

SEQ ID NO: 10025 - protein, 458 aa, Artificial Sequence
  Description of Artificial Sequence: Synthetic coding sequence
MRGLAVLLTVALATLLAPGAGAPVQSQGSQNKLLLVSFDGFRWNYDQDVDTPNLDAMARDGVKARYMTPAFVTMTSPCHFTLVTGKYIENHGVVHNMYYNTTSKVKLPYHATLGIQRWWDNGSVPIWITAQRQGLRAGSFFYPGGNVTYQGVAVTRSRKEGIAHNYKNETEWRANIDTVMAWFTEEDLDLVTLYFGEPDSTGHRYGPESPERREMVRQVDRTVGYLRESIARNHLTDRLNLIITSDHGMTTVDKRAGDLVEFHKFPNFTFRDIEFELLDYGPNGMLLPKEGRLEKVYDALKDAHPKLHVYKKEAFPEAFHYANNPRVTPLLMYSDLGYVIHGRINVQFNNGEHGFDNKDMDMKTIFRAVGPSFRAGLEVEPFESVHVYELMCRLLGIVPEANDGHLATLLPMLHTESALPPDGRPTLLPKGRSALPPSSRPLLVMGLLGTVILLSEVA

SEQ ID NO: 10026 - protein, 434 aa, Artificial Sequence
  Description of Artificial Sequence: Synthetic coding sequence
MAAAAGSCARVAAWGGKLRRGLAVSRQAVRSPGPLAAAVAGAALAGAGAAWHHSRVSVAARDGSFTVSAQKNVEHGIIYIGKPSLRKQRFMQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKLQKIISKQDDLMTVKTNETGYQEAIVKEPEINTTLQMRFFGKRGQRKLHYKEFRRFMENLQTEIQEMEFLQFSKGLSFMRKEDFAEWLLFFTNTENKDIYWKNVREKLSAGESISLDEFKSFCHFTTHLEDFAIAMQMFSLAHRPVRLAEFKRAVKVATGQELSNNILDTVFKIFDLDGDECLSHEEFLGVLKNRMHRGLWVPQHQSIQEYWKCVKKESIKGVKEVWKQAGKGLF

SEQ ID NO: 10027 - protein, 530 aa, Artificial Sequence
  Description of Artificial Sequence: Synthetic coding sequence
MAALRRLLWPPPRVSPPLCAHQPLLGPWGRPAVTTLGLPGRPFSSREDEERAVAEAAWRRRRRWGELSVAAAAGGGLVGLVCYQLYGDPRAGSPATGRPSKSAATEPEDPPRGRGMLPIPVAAAKETVAIGRTDIEDLDLYATSRERRFRLFASIECEGQLFMTPYDFILAVTTDEPKVAKTWKSLSKQELNQMLAETPPVWKGSSKLFRNLKEKGVISYTEYLFLLCILTKPHAGFRIAFNMFDTDGNEMVDKKEFLVLQEIFRKKNEKREIKGDEEKRAMLRLQLYGYHSPTNSVLKTDAEELVSRSYWDTLRRNTSQALFSDLAERADDITSLVTDTTLLVHFFGKKGKAELNFEDFYRFMDNLQTEVLEIEFLSYSNGMNTISEEDFAHILLRYTNVENTSVFLENVRYSIPEEKGITFDEFRSFFQFLNNLEDFAIALNMYNFASRSIGQDEFKRAVYVATGLKFSPHLVNTVFKIFDVDKDDQLSYKEFIGIMKDRLHRGFRGYKTVQKYPTFKSCLKKELHSR

SEQ ID NO: 10028 - protein, 177 aa, Artificial Sequence
  Description of Artificial Sequence: Synthetic coding sequence
MFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKWNWVCRWAPRTGSRGSGWQQLERLPSSALALQQPQNIGPGHQRVQPLRGGDQGRAGGKEEAGGGDEAAESGLQGAAVHL

SEQ ID NO: 10029 - protein, 240 aa, Artificial Sequence
  Description of Artificial Sequence: Synthetic coding sequence
MATDELATKLSRRLQMEGEGGGETPEQPGLNGAAAAAAGAPDEAAEALGSADCELSAKLLRRADLNQGIGEPQSPSRRVFNPYTEFKEFSRKQIKDMEKMFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKVQAINVSSRFEEEIKAEQEERKKQAEEMKQRKAAFKELQSTFK

SEQ ID NO: 10030 - protein, 179 aa, Artificial Sequence
  Description of Artificial Sequence: Synthetic coding sequence
  MOD_RES (1)..(1): Any amino acid
XKMFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKWNWVCRWAPRTGSRGSGWQQLERLPSSALALQQPQNIGPGHQRVQPLRGGDQGRAGGKEEAGGGDEAAESGLQGAAVHL

SEQ ID NO: 10031 - protein, 690 aa, Artificial Sequence
  Description of Artificial Sequence: Synthetic coding sequence
MKRLPLLVVFSTLLNCSYTQNCTKTPCLPNAKCEIRNGIEACYCNMGFSGNGVTICEDDNECGNLTQSCGENANCTNTEGSYYCMCVPGFRSSSNQDRFITNDGTVCIENVNANCHLDNVCIAANINKTLTKIRSIKEPVALLQEVYRNSVTDLSPTDIITYIEILAESSSLLGYKNNTISAKDTLSNSTLTEFVKTVNNFVQRDTFVVWDKLSVNHRRTHLTKLMHTVEQATLRISQSFQKTTEFDTNSTDIALKVFFFDSYNMKHIHPHMNMDGDYINIFPKRKAAYDSNGNVAVAFVYYKSIGPLLSSSDNFLLKPQNYDNSEEEERVISSVISVSMSSNPPTLYELEKITFTLSHRKVTDRYRSLCAFWNYSPDTMNGSWSSEGCELTYSNETHTSCRCNHLTHFAILMSSGPSIGIKDYNILTRITQLGIIISLICLAICIFTFWFFSEIQSTRTTIHKNLCCSLFLAELVFLVGINTNTNKLFCSIIAGLLHYFFLAAFAWMCIEGIHLYLIVVGVIYNKGFLHKNFYIFGYLSPAVVVGFSAALGYRYYGTTKVCWLSTENNFIWSFIGPACLIILVNLLAFGVIIYKVFRHTAGLKPEVSCFENIRSCARGALALLFLLGTTWIFGVLHVVHASVVTAYLFTVSNAFQGMFIFLFLCVLSRKIQEEYYRLFKNVPCCFGCLR

SEQ ID NO: 10032 - protein, 149 aa, Artificial Sequence
  Description of Artificial Sequence: Synthetic coding sequence
VVVGFSAALGYRYYGTTKVCWLSTENNFIWSFIGPACLIILVNLLAFGVIIYKVFRHTAGLKPEVSCFENIRSCARGALALLFLLGTTWIFGVLHVVHASVVTAYLFTVSNAFQGMFIFLFLCVLSRKIQEEYYRLFKNVPCCFGCLSC

SEQ ID NO: 10033 - protein, 823 aa, Artificial Sequence
  Description of Artificial Sequence: Synthetic coding sequence
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 10034 - protein, 823 aa, Artificial Sequence; identical to SEQ ID NO: 10033
  Description of Artificial Sequence: Synthetic coding sequence

SEQ ID NO: 10035 - protein, 774 aa, Artificial Sequence
  Description of Artificial Sequence: Synthetic coding sequence
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 10036 - protein, 681 aa, Artificial Sequence
  Description of Artificial Sequence: Synthetic coding sequence
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 10037 - protein, 730 aa, Artificial Sequence
  Description of Artificial Sequence: Synthetic coding sequence
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 10038 - protein, 239 aa, Artificial Sequence
  Description of Artificial Sequence: Synthetic coding sequence
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEGRELRSHVPRDPQTSDHMFNGAHTNQAE

SEQ ID NO: 10039 - protein, 379 aa, Artificial Sequence
  Description of Artificial Sequence: Synthetic coding sequence
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGGGSRADCHHLHGAERLSAVPPPGGPHFSPV

SEQ ID NO: 10040 - protein, 225 aa, Artificial Sequence
  Description of Artificial Sequence: Synthetic coding sequence
MTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPVSDPETEGALCLLGAWPEWMWSLGHHRLQHNRHQRHQHHLPLHPPEQLCRPHGPLRCAGGGSRADCHHLHGAERLSAVPPPGGPHFSPV

SEQ ID NO: 10041 - protein, 765 aa, Artificial Sequence
  Description of Artificial Sequence: Synthetic coding sequence
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHREEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 10042 - protein, 812 aa, Artificial Sequence
  Description of Artificial Sequence: Synthetic coding sequence
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 10043 - protein, 957 aa, Artificial Sequence
  Description of Artificial Sequence: Synthetic coding sequence
MYGSARTITNLEGSPSRSPRLPRSPRLGHRRTSSGGGGGTGKTLSMENIQSLNAAYATSGPMYLSDHEGVASTTYPKGTMTLGRATNRAVYGGRVTAMGSSPNIASAGLSHTDVLSYTDQHGGLTGSSHHHHHQVPSMLRQVRDSTMLDLQAQLKELQRENDLLRKELDIKDSKLGSSMNSIKTFWSPELKKERVLRKEEAARMSVLKEQMRVSHEENQHLQLTIQALQDELRTQRDLNHLLQQESGNRGAEHFTIELTEENFRRLQAEHDRQAKELFLLRKTLEEMELRIETQKQTLNARDESIKKLLEMLQSKGLPSKSLEDDNERTRRMAEAESQVSHLEVILDQKEKENIHLREELHRRSQLQPEPAKTKALQTVIEMKDTKIASLERNIRDLEDEIQMLKANGVLNTEDREEEIKQIEVYKSHSKFMKTKIDQLKQELSKKESELLALQTKLETLSNQNSDCKQHIEVLKESLTAKEQRAAILQTEVDALRLRLEEKESFLNKKTKQLQDLTEEKGTLAGEIRDMKDMLEVKERKINVLQKKIENLQEQLRDKDKQLTNLKDRVKSLQTDSSNTDTALATLEEALSEKERIIERLKEQRERDDRERLEEIESFRKENKDLKEKVNALQAELTEKESSLIDLKEHASSLASAGLKRDSKLKSLEIAIEQKKEECSKLEAQLKKAHNIEDDSRMNPEFADQIKQLDKEASYYRDECGKAQAEVDRLLEILKEVENEKNDKDKKIAELESLTLRHMKDQNKKVANLKHNQQLEKKKNAQLLEEVRRREDSMADNSQHLQIEELMNALEKTRQELDATKARLASTQQSLAEKEAHLANLRIERRKQLEEILEMKQEALLAAISEKDANIALLELSASKKKKTQEEVMALKREKDRLVHQLKQQTQNRMKLMADNYDDDHHHYHHHHHHHHHRSPGRSQHSNHRPSPDQDDEEGIWA

SEQ ID NO: 10044 - protein, 957 aa, Artificial Sequence; identical to SEQ ID NO: 10043
  Description of Artificial Sequence: Synthetic coding sequence

SEQ ID NO: 10045 - protein, 528 aa, Artificial Sequence
  Description of Artificial Sequence: Synthetic coding sequence
  MOD_RES (1)..(1): Any amino acid
XRSQLQPEPAKTKALQTVIEMKDTKIASLERNIRDLEDEIQMLKANGVLNTEDREEEIKQIEVYKSHSKFMKTKIDQLKQELSKKESELLALQTKLETLSNQNSDCKQHIEVLKESLTAKEQRAAILQTEVDALRLRLEEKESFLNKKTKQLQDLTEEKGTLAGEIRDMKDMLEVKERKINVLQKKIENLQEQLRDKDKQLTNLKDRVKSLQTDSSNTDTALATLEEALSEKERIIERLKEQRERDDRERLEEIESFRKENKDLKEKVNALQAELTEKESSLIDLKEHASSLASAGLKRDSKLKSLEIAIEQKKEECSKLEAQLKKQAEQLFNQMYNPAHNIEDDSRMNPEFADQIKQLDKEASYYRDECGKAQAEVDRLLEILKEVENEKNDKDKKIAELERHMKDQNKKVANLKHNQQLEKKKNAQLLEEVRRREDSMADNSQHLQIEELMNALEKTRQELDATKARLASTQQSLAEKEAHLANLRIERRKQLEEILEMKQEALLAAISEKDANIALLELSASKKK

SEQ ID NO: 10046 - protein, 327 aa, Artificial Sequence
  Description of Artificial Sequence: Synthetic coding sequence
MRALPGLLEARARTPRLLLLQCLLAAARPSSADGSAPDSPFTSPPLREEIMANNFSLESHNISLTEHSSMPVEKNITLERPSNVNLTCQFTTSGDLNAVNVTWKKDGEQLENNYLVSATGSTLYTQYRFTIINSKQMGSYSCFFREEKEQRGTFNFKVPELHGKNKPLISYVGDSTVLTCKCQNCFPLNWTWYSSNGSVKVPVGVQMNKYVINGTYANETKLKITQLLEEDGESYWCRALFQLGESEEHIELVVLSYLVPLKPFLVIVAEVILLVATILLCEKYTQKKKKHSDEGKEFEQIEQLKSDDSNGIENNVPRHRKNESLGQ

SEQ ID NO: 10047 - protein, 206 aa, Artificial Sequence
  Description of Artificial Sequence: Synthetic coding sequence
MGAEWELGAEAGGSLLLCAALLAAGCALGLRLGRGQGAADRGALIWLCYDALVHFALEGPFVYLSLVGNVANSDGLIASLWKEYGKADARWVYFDPTIVSVEILTVALDGSLALFLIYAIVKEKYYRHFLQITLCVCELYGCWMTFLPEWLTRSPNLNTSNWLYCWLYLFFFNGVWVLIPGLLLWQSWLELKKMHQKETSSVKKFQ

SEQ ID NO: 10048 - protein, 86 aa, Artificial Sequence
  Description of Artificial Sequence: Synthetic coding sequence
MGAEWELGAEAGGSLLLCAALLAAGCALGLRLGRGQGAADRGALIWLCYDALVHFALERVGKTTNQESAGVLGSTEWNFKNTDKLL

SEQ ID NO: 10049 - protein, 418 aa, Artificial Sequence
  Description of Artificial Sequence: Synthetic coding sequence
MATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRMKPAGSVNDMALDAFDLDRMKQEILEEVVRELHKVKEEIIDAIRQELSGISTT

SEQ ID NO: 10050 - protein, 416 aa, Artificial Sequence
  Description of Artificial Sequence: Synthetic coding sequence
MSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRMKPAGSVNDMALDAFDLDRMKQEILEEVVRELHKVKEEIIDAIRQELSGISTT

SEQ ID NO: 10051 - protein, 381 aa, Artificial Sequence
  Description of Artificial Sequence: Synthetic coding sequence
MATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGAPSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRMKPAGSVNDMALDAFDLDRMKQEILEEVVRELHKVKEEIIDAIRQELSGISTT

SEQ ID NO: 10052 - protein, 390 aa, Artificial Sequence
  Description of Artificial Sequence: Synthetic coding sequence
MFAFEEFSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRYRTTLLLTCPPGFGAPLSPVP

SEQ ID NO: 10053 - protein, 212 aa, Artificial Sequence
  Description of Artificial Sequence: Synthetic coding sequence
PPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRMKPAGSVNDMALDAFDLDRMKQEILEEVVRELHKVKEEIIDAIRQELSGISTT

SEQ ID NO: 10054 - protein, 538 aa, Artificial Sequence
  Description of Artificial Sequence: Synthetic coding sequence
MGLLLLVLILTPSLAAYRHPDFPLLEKAQQLLQSTGSPYSTNCWLCTSSSTETPGTAYPASPREWTSIEAELHISYRWDPNLKGLMRPANSLLSTVKQDFPDIRQKPPIFGPIFTNINLMGIAPICVMAKRKNGTNVGTLPSTVCNVTFTVDSNQQTYQTYTHNQFRHQPRFPKPPNITFPQGTLLDKSSRFCQGRPSSCSTRNFWFRPADYNQCLQISNLSSTAEWVLLDQTRNSLFWENKTKGANQSQTPCVQVLAGMTIATSYLGISAVSEFFGTSLTPLFHFHISTCLKTQGAFYICGQSIHQCLPSNWTGTCTIGYVTPDIFIAPGNLSLPIPIYGNSPLPRVRRAIHFIPLLAGLGILAGTGTGIAGITKASLTYSQLSKEIANNIDTMAKALTTMQEQIDSLAAVVLQNRRGLDMLTAAQGGICLALDEKCCFWVNQSGKVQDNIRQLLNQASSLRERATQGWLNWEGTWKWFSWVLPLTGPLVSLLLLLLFGPCLLNLITQFVSSRLQAIKLQTNLSAGRHPRNIQESPF

SEQ ID NO: 10055 - protein, 538 aa, Artificial Sequence; identical to SEQ ID NO: 10054
  Description of Artificial Sequence: Synthetic coding sequence

SEQ ID NO: 10056 - protein, 538 aa, Artificial Sequence
  Description of Artificial Sequence: Synthetic coding sequence
MALPYHIFLFTVLLPSFTLTAPPPCRCMTSSSPYQEFLWRMQRPGNIDAPSYRSLSKGTPTFTAHTHMPRNCYHSATLCMHANTHYWTGKMINPSCPGGLGVTVCWTYFTQTGMSDGGGVQDQAREKHVKEVISQLTRVHGTSSPYKGLDLSKLHETLRTHTRLVSLFNTTLTGLHEVSAQNPTNCWICLPLNFRPYVSIPVPEQWNNFSTEINTTSVLVGPLVSNLEITHTSNLTCVKFSNTTYTTNSQCIRWVTPPTQIVCLPSGIFFVCGTSAYRCLNGSSESMCFLSFLVPPMTIYTEQDLYSYVISKPRNKRVPILPFVIGAGVLGALGTGIGGITTSTQFYYKLSQELNGDMERVADSLVTLQDQLNSLAAVVLQNRRALDLLTAERGGTCLFLGEECCYYVNQSGIVTEKVKEIRDRIQRRAEELRNTGPWGLLSQWMPWILPFLGPLAAIILLLLFGPCIFNLLVNFVSSRIEAVKLQMEPKMQSKTKIYRRPLDRPASPRSDVNDIKGTPPEEISAAQPLLRPNSAGSS

SEQ ID NO: 10057 - protein, 569 aa, Artificial Sequence
  Description of Artificial Sequence: Synthetic coding sequence
MGSTLGCHRSIPRDPSDLSHSRKFSAACNFSNILVNQERLNINTATEEELMTLPGVTRAVARSIVEYREYIGGFKKVEDLALVSGVGATKLEQVKFEICVSSKGSSAQHSPSSLRRDLLAEQQPHHLATAVPLTPRVNINTATPAQLMSVRGLSEKMALSIVDFRREHGPFRSVEDLVRMDGINAAFLDRIRHQVFAERSRPPSTHTNGGLTFTAKPHPSPTSLSLQSEDLDLPPGGPTQIISTRPSVEAFGGTRDGRPVLRLATWNLQGCSVEKANNPGVREVVCMTLLENSIKLLAVQELLDREALEKFCTELNQPTLPNIRKWKGPRGCWKAVVAEKPSSQLQKGAGYAGFLWDAAAGMELRDAGSQESSPSNGHGKLAGPSPYLGRFKVGSHDLTLVNLHLAALTLLGSENPSKNHSDGHRLASFAQTLQETLKGEKDVIILGDFGQGPDSNDYDILRKEKFHHLIPAHTFTNISTKNPQGSKSLDNIWISKSLKKVFTGHWAVVREGLTNPWIPDNWSWGGVASEHCPVLAEFYTEKDWSKKDAPRNGSGVALERSEANIKHER

SEQ ID NO: 10058 - protein, 569 aa, Artificial Sequence; identical to SEQ ID NO: 10057
  Description of Artificial Sequence: Synthetic coding sequence

SEQ ID NO: 10059 - protein, 273 aa, Artificial Sequence
  Description of Artificial Sequence: Synthetic coding sequence
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 10060 - protein, 977 aa, Artificial Sequence
  Description of Artificial Sequence: Synthetic coding sequence
MPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEEVINLVDQTSENAPTTVSRDVEEKPAHAPARPEAPVDSMLKDMATIILSTFLLIGWVAFIITYPLSMHQQQQLQHQQFQKELEKIQLLQQQQQQLPFHPPGDTAQDGELLDTSGPYSESSGTSSPSTSPRASNHSLCSGSSASKAGSSPSLEQDDGDEETSVVIVGKISFCPKDVLGHGAEGTIVYRGMFDNRDVAVKRILPECFSFADREVQLLRESDEHPNVIRYFCTEKDRQFQYIAIELCAATLQEYVEQKDFAHLGLEPITLLQQTTSGLAHLHSLNIVHRDLKPHNILISMPNAHGKIKAMISDFGLCKKLAVGRHSFSRRSGVPGTEGWIAPEMLSEDCKENPTYTVDIFSAGCVFYYVISEGSHPFGKSLQRQANILLGACSLDCLHPEKHEDVIARELIEKMIAMDPQKRPSAKHVLKHPFFWSLEKQLQFFQDVSDRIEKESLDGPIVKQLERGGRAVVKMDWRENITVPLQTDLRKFRTYKGGSVRDLLRAMRNKKHHYRELPAEVRETLGSLPDDFVCYFTSRFPHLLAHTYRAMELCSHERLFQPYYFHEPPEPQPPVTPDAL

SEQ ID NO: 10061 - protein, 290 aa, Artificial Sequence
  Description of Artificial Sequence: Synthetic coding sequence
MPFDFRRFDIYRKVPKDLTQPTYTGAIISICCCLFILFLFLSELTGFITTEVVNELYVDDPDKDSGGKIDVSLNISLPNLHCELVGLDIQDEMGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 10062 - protein, 35 aa, Artificial Sequence
  Description of Artificial Sequence: Synthetic coding sequence
  MOD_RES (1)..(1): Any amino acid
XCSTANGEKDSITLISMKNINMNNGKQSLSAEKVL

SEQ ID NO: 10063 - protein, 72 aa, Artificial Sequence
  Description of Artificial Sequence: Synthetic coding sequence
MGTAGAMQLCWVILGFLLFRGHNSQPTMTQTSSSQGGLGGLSLTTEPVSSNPGYIPSSEANRPSHLSSTGTP

SEQ ID NO: 10064 - protein, 255 aa, Artificial Sequence
  Description of Artificial Sequence: Synthetic coding sequence
MASPGAGRAPPELPERNCGYREVEYWDQRYQGAADSAPYDWFGDFSSFRALLEPELRPEDRILVLGCGNSALSYELFLGGFPNVTSVDYSSVVVAAMQARHAHVPQLRWETMDVRKLDFPSASFDVVLEKGTLDALLAGERDPWTVSSEGVHTVDQVLSEVSRVLVPGGRFISMTSAAPHFRTRHYAQAYYGWSLRHATYGSGFHFHLYLMHKGGKLSVAQLALGAQILSPPRPPTSPCFLQDSDHEDFLSAIQL

SEQ ID NO: 10065 - protein, 736 aa, Artificial Sequence
  Description of Artificial Sequence: Synthetic coding sequence
MNVALQELGAGSNVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 10066 - protein, 883 aa, Artificial Sequence
  Description of Artificial Sequence: Synthetic coding sequence
MASPGAGRAPPELPERNCGYREVEYWDQRYQGAADSAPYDWFGDFSSFRALLEPELRPEDRILVLGCGNSALSYELFLGGFPNVTSVDYSSVVVAAMQARHAHVPQLRWETMDVRKLDFPSASFDVVLEKGTLDALLAGERDPWTVSSEGVHTVDQVLSEVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 10067 - protein, 765 aa, Artificial Sequence
  Description of Artificial Sequence: Synthetic coding sequence
MNVALQELGAGSNMVEYKRATLRDEDAPETPVEGGASPDAMEVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 10068 - protein, 811 aa, Artificial Sequence
  Description of Artificial Sequence: Synthetic coding sequence
MNVALQELGAGSNMVEYKRATLRDEDAPETPVEGGASPDAMEVGKGASPFSPGPSPGMTPGTPRSSGLFWRVTCPHLRSISGLCSRTMVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 10069 - protein, 261 aa, Artificial Sequence
  Description of Artificial Sequence: Synthetic coding sequence
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 10070 - protein, 292 aa, Artificial Sequence
  Description of Artificial Sequence: Synthetic coding sequence
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 10071 - protein, 246 aa, Artificial Sequence
  Description of Artificial Sequence: Synthetic coding sequence
MNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 10072 - protein, 127 aa, Artificial Sequence
  Description of Artificial Sequence: Synthetic coding sequence
MNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAGTGPGLGAGGGARESGVSETG

SEQ ID NO: 10073 - protein, 219 aa, Artificial Sequence
  Description of Artificial Sequence: Synthetic coding sequence
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQVDIASGMAIEGMCYAQ

SEQ ID NO: 10074 - protein, 303 aa, Artificial Sequence
  Description of Artificial Sequence: Synthetic coding sequence
MAAVAVLRAFGASGPMCLRRGPWAQLPARFCSRDPAGAGRRESEPRPTSARQLDGIRNIVLSNPKKRNALSLAMLKSLQSDILHDADSNDLKVIIISAEGPVFSSGHDLKELTEEQGRDYHAEVFQTCSKVMMHIRNHPVPVIAMVNGLAAAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 10075 - protein, 241 aa, Artificial Sequence
  Description of Artificial Sequence: Synthetic coding sequence
MAAVAVLRAFGASGPMCLRRGPWAQLPARFCSRDPAGAGRRESEPRPTSARQLDGIRSAPGRAGSSRWCRVGVRAPPLTRGGPGEPEPRLRPWGGNSPCPGPGPGSETRRNIVLSNPKKRNALSLAMLKSLQSDILHDADSNDLKVIIISAEGPVFSSGHDLKELTEEQGRDYHAEVFQTCSKVMMHIRNHPVPVIAMVNGLAAAAGCQLVASCDIAVASDKSSFATPGVNVGLFCSTPGV

SEQ ID NO: 10076 - protein, 166 aa, Artificial Sequence
  Description of Artificial Sequence: Synthetic coding sequence
MLKSLQSDILHDADSNDLKVIIISAEGPVFSSGHDLKELTEEQGRDYHAEVFQTCSKVMMHIRNHPVPVIAMVNGLAAAAGCQLVASCDIAVASDKSSFATPGVNVGLFCSTPGVALARAVPRKVALEMLFTGEPISAQEALLHGLLSKVVPEAELQEETMRIARK

SEQ ID NO: 10077 - protein, 302 aa, Artificial Sequence
  Description of Artificial Sequence: Synthetic coding sequence
MALVASVRVPARVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 10078 - protein, 285 aa, Artificial Sequence
  Description of Artificial Sequence: Synthetic coding sequence
MALVASVRVPARVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 10079 - protein, 364 aa, Artificial Sequence
  Description of Artificial Sequence: Synthetic coding sequence
MNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 10080 - protein, 394 aa, Artificial Sequence
  Description of Artificial Sequence: Synthetic coding sequence
MAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 10081 - protein, 364 aa, Artificial Sequence; identical to SEQ ID NO: 10079
  Description of Artificial Sequence: Synthetic coding sequence

SEQ ID NO: 10082 - protein, 227 aa, Artificial Sequence
  Description of Artificial Sequence: Synthetic coding sequence
MYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 10083 - protein, 364 aa, Artificial Sequence; identical to SEQ ID NO: 10079
  Description of Artificial Sequence: Synthetic coding sequence

SEQ ID NO: 10084 - protein, 986 aa, Artificial Sequence
  Description of Artificial Sequence: Synthetic coding sequence
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 10085 - protein, 935 aa, Artificial Sequence
  Description of Artificial Sequence: Synthetic coding sequence
MKWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 10086 - protein, 949 aa, Artificial Sequence
  Description of Artificial Sequence: Synthetic coding sequence
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQE

SEQ ID NO: 10087 - protein, 986 aa, Artificial Sequence; identical to SEQ ID NO: 10084
  Description of Artificial Sequence: Synthetic coding sequence

SEQ ID NO: 10088 - protein, 91 aa, Artificial Sequence
  Description of Artificial Sequence: Synthetic coding sequence
MAGIFYFALFSCLFGICDAVTGSRVYPANEVTLLDSRSVQGELGWIASPLEGGWEEVSIMDEKNTPIRTYQVCNVMEPSQNNWLRTDWITR

SEQ ID NO: 10089 - protein, 149 aa, Artificial Sequence
  Description of Artificial Sequence: Synthetic coding sequence
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIA

SEQ ID NO: 10090 - protein, 279 aa, Artificial Sequence
  Description of Artificial Sequence: Synthetic coding sequence
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCERK

SEQ ID NO: 10091 - protein, 998 aa, Artificial Sequence
  Description of Artificial Sequence: Synthetic coding sequence
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 10092 - protein, 228 aa, Artificial Sequence
  Description of Artificial Sequence: Synthetic coding sequence
MLHVEMLTLVFLVLWMCVFSQDPGSKAVADRYAVYWNSSNPRFQRGDYHIDVCINDYLDVFCPHYEDSVPEDKTERYVLYMVNFDGYSACDHTSKGFKRWECNRPHSPNGPLKFSEKFQLFTPFSLGFEFRPGREYFYISSAIPDNGRRSCLKLKVFVRPTNSCMKTIGVHDRVFDVNDKVENSLEPADDTVHESAEPSRGENAAQTPRIPSRLLAILLFLLAMLLTL

SEQ ID NO: 10093 - protein, 864 aa, Artificial Sequence
  Description of Artificial Sequence: Synthetic coding sequence
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKPPPSGPFTSSLGGAGFSDDPFKSKQDTPALPPKKPAPPRPKPPSGKSTPVSQLGSADFPEAPDPFQPLGADSGDPFQSKKGFGDPFSGKDPFVPSSAAKPSKASASGFADFTSVS

SEQ ID NO: 10094 - protein, 910 aa, Artificial Sequence
  Description of Artificial Sequence: Synthetic coding sequence
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKPPPSGPFTSSLGGAGFSDDPFKSKQDTPALPPKKPAPPRPKPPSGKSTPVSQLGSADFPEAPDPFQPLGADSGDPFQSKKGFGDPFSGKDPFVPSSAAKPSKASASGFADFTSFGNEEQQLAWAKRESEKAEQERLARLRRQEQEDLELAIALSKADMPAA

SEQ ID NO: 10095 - protein, 754 aa, Artificial Sequence
  Description of Artificial Sequence: Synthetic coding sequence
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKVKVHL

SEQ ID NO: 10096 - protein, 601 aa, Artificial Sequence
  Description of Artificial Sequence: Synthetic coding sequence
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMVKVE

SEQ ID NO: 10097 - protein, 607 aa, Artificial Sequence
  Description of Artificial Sequence: Synthetic coding sequence
MWMTPKRSKMEVDEALVFRPEWTQRYLVVEPPEGDGALCLVCRRLIVATRERDVRRHYEAEHEYYERYVADGERAALVERLRQGDLPVASFTPEERAARAGLGLCRLLALKGRGWGEGDFVYQCMEVLLREVLPEHVSVLQGVDLSPDITRQRILSIDRNLRNQLFNRARDFKAYSLALDDQAFVAYENYLLVFIRGVGPELEVQEDLLTIINLTHHFSVGALMSAILESLQTAGLSLQRMVGLTTTHTLRMIGENSGLVSYMREKAVSPNCWNVIHYSGFLHLELLSSYDVDVNQIINTISEWIVLIKTRGVRRPEFQTLLTESESEHGERVNGRCLNNWLRRGKTLKLIFSLRKEMEAFLVSVGATTVHFSDKQWLCDFGFLVDIMEHLRELSEELRVSKVFAAAAFDHICTFEVKLNLFQRHIEEKNLTDFPALREVVDELKQQNKEDEKIFDPDRYQMVICRLQKEFERHFKDLRFIKKDLELFSNPFNFKPEYAPISVRVELTKLQANTNLWNEYRIKDLGQFYAGLSAESYPIIKGVACKVASLFDSNQICEKAFSYLTRNQHTLSQPLTDEHLQALFRVATTEMEPGWDDLVRERNESNP

SEQ ID NO: 10098 - protein, 362 aa, Artificial Sequence
  Description of Artificial Sequence: Synthetic coding sequence
MARLRDCLPRLMLTLRSLLFWSLVYCYCGLCASIHLLKLLWSLGKGPAQTFRRPAREHPPACLSDPSLGTHCYVRIKDSGLRFHYVAAGERGKPLMLLLHGFPEFWYSWRYQLREFKSEYRVVALDLRGYGETDAPIHRQNYKLDCLITDIKDILDSLGYSKCVLIGHDWGGMIAWLIAICYPEMVMKLIVINFPHPNVFTEYILRHPAQLLKSSYYYFFQIPWFPEFMFSINDFKVLKHLFTSHSTGIGRKGCQLTTEDLEAYIYVFSQPGALSGPINHYRNIFSCLPLKHHMVTTPTLLLWGENDAFMEVEMAEVTKIYVKNYFRLTILSEASHWLQQDQPDIVNKLIWTFLKEETRKKD

SEQ ID NO: 10099 - protein, 657 aa, Artificial Sequence
  Description of Artificial Sequence: Synthetic coding sequence
MQWRALVLGLVLLRLGLHGVLWLVFGLGPSMGFYQRFPLSFGFQRLRSPDGPASPTSGPVGRPGGVSGPSWLQPPGTGAAQSPRKAPRRPGPGMCGPANWGYVLGGRGRGPDEYEKRYSGAFPPQLRAQMRDLARGMFVFGYDNYMAHAFPQDELNPIHCRGRGPDRGDPSNLNINDVLGNYSLTLVDALDTLAIMGNSSEFQKAVKLVINTVSFDKDSTVQVFEATIRVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQNYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSTEDRMESFFLSETCKYLYLLFDEDNPVHKSGTRYMFTTEGHIVSVDEHLRELPWKEFFSEEGGQDQGGKSVHRPKPHELKVINSSSNCNRVPDERRYSLPLKSIYMRQIDQMVGLI

SEQ ID NO: 10100 - protein, 212 aa, Artificial Sequence
  Description of Artificial Sequence: Synthetic coding sequence
MHWIHLQVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQNYLRRGREACNEGEGDPPLCQREHVQWAADEHLD

SEQ ID NO: 10101 - protein, 376 aa, Artificial Sequence
  Description of Artificial Sequence: Synthetic coding sequence
MGNSSEFQKAVKLVINTVSFDKDSTVQVFEATIRVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQNYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSTEDRMESFFLSETCKYLYLVCVLQDEPRNI

SEQ ID NO: 10102 - protein, 932 aa, Artificial Sequence
  Description of Artificial Sequence: Synthetic coding sequence
MSEAGGRGCGSPVPQRARWRLVAATAAFCLVSATSVWTAGAEPMSREEKQKLGNQVLEMFDHAYGNYMEHAYPADELMPLTCRGRVRGQEPSRGDVDDALGKFSLTLIDSLDTLVVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKALDFLWEKRQRSSNLVGVTINIHTGDWVRKDSGVGAGIDSYYEYLLKAYVLLGDDSFLERFNTHYDAIMRYISQPPLLLDVHIHKPMLNARTWMDALLAFFPGLQVLKGDIRPAIETHEMLYQVIKKHNFLPEAFTTDFRVHWAQHPLRPEFAESTYFLYKATGDPYYLEVGKTLIENLNKYARVPCGFAAMKDVRTGSHEDRMDSFFLAEMFKYLYLLFADKEDIIFDIEDYIFTTEAHLLPLWLSTTNQSISKKNTTSEYTELDDSNFDWTCPNTQILFPNDPLYAQSIREPLKNVVDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRDPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 10103 - protein, 905 aa, Artificial Sequence
  Description of Artificial Sequence: Synthetic coding sequence
MSREEKQKLGNQVLEMFDHAYGNYMEHAYPADELMPLTCRGRVRGQEPSRGDVDDALGKFSLTLIDSLDTLVVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKALDFLWEKRQRSSNLVGVTINIHTGDWVRKDSGVGAGIDSYYEYLLKAYVLLGDDSFLERFNTHYDAIMRYISQPPLLLDVHIHKPMLNARTWMDALLAFFPGLQVLKGDIRPAIETHEMLYQVIKKHNFLPEAFTTDFRVHWAQHPLRPEFAESTYFLYKATGDPYYLEVGKTLIENLNKYARVPCGFAAMKDVRTGSHEDRMDSFFLAEMFKYLYLLFADKEDIIFDIEDYIFTTEAHLLPLWLSTTNQSISKKNTTSEYTELDDSNFDWTCPNTQILFPNDPLYAQSIREPLKNVVDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRAAILKGKMIPSYIINSNPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 10104 - protein, 437 aa, Artificial Sequence
  Description of Artificial Sequence: Synthetic coding sequence
MAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 10105 - protein, 243 aa, Artificial Sequence
  Description of Artificial Sequence: Synthetic coding sequence
MSRMSSWSITLICLRIPGSYEWSSWEPRMQGSQHSPTSYWAERCSLFPGRCILLAAKLWGSSQRRRPRWWVPTKGVLETGQRVKLRGSPLPSALKKMMVTFIYILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFK

SEQ ID NO: 10106 - protein, 388 aa, Artificial Sequence
  Description of Artificial Sequence: Synthetic coding sequence
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVQGEEVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 10107 - protein, 383 aa, Artificial Sequence
  Description of Artificial Sequence: Synthetic coding sequence
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 10108 - protein, 198 aa, Artificial Sequence
  Description of Artificial Sequence: Synthetic coding sequence
LSVAFSCCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFAHLPLSTSHPEEN

SEQ ID NO: 10109 - protein, 388 aa, Artificial Sequence
  Description of Artificial Sequence: Synthetic coding sequence
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHAVEIHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 10110 - protein, 398 aa, Artificial Sequence
  Description of Artificial Sequence: Synthetic coding sequence
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHGCVCRLKMIARSLACVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 10111 - protein, 468 aa, Artificial Sequence
  Description of Artificial Sequence: Synthetic coding sequence
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 10112 - protein, 173 aa, Artificial Sequence
  Description of Artificial Sequence: Synthetic coding sequence
WGPNIKEFKHRFDPVETKGEGPRRLKNLYFLYLIELRALSKVAPYFERSIVDLYTGNAEEDADTKTLLLNIFQDTKSFPMHFDEKSMFAGDKKGAKSLKEEFRLHFKNISRIMDCVGCDKCRLWGKLQTQGLGTALKILFSEKEIQKLPENSPSKGFQLTRQEIVALLNAFGR

SEQ ID NO: 10113 - protein, 144 aa, Artificial Sequence
  Description of Artificial Sequence: Synthetic coding sequence
MSQGVRRAGAGQGVAAAVQLLVTLSFLRSVVEAQVTGVLDDCLCDIDSIDNFNTYKIFPKIKKLQERDYFRYYKVNLKRPCPFWAEDGHCSIKDCHVEPCPESKIPVGIKAGHSNKYLKMANNTKELEDCEQANKLGAINSTLR

SEQ ID NO: 10114 - protein, 467 aa, Artificial Sequence
  Description of Artificial Sequence: Synthetic coding sequence
MSQGVRRAGAGQGVAAAVQLLVTLSFLRSVVEAQVTGVLDDCLCDIDSIDNFNTYKIFPKIKKLQERDYFRYYKVNLKRPCPFWAEDGHCSIKDCHVEPCPESKIPVGIKAGHSNKYLKMANNTKELEDCEQANKLGAINSTLSNQSKEAFIDWARYDDSRDHFCELDDERSPAAQYVDLLLNPERYTGYKGTSAWRVWNSIYEENCFKPRSVYRPLNPLAPSRGEDDGESFYTWLEGLCLEKRVFYKLISGLHASINLHLCANYLLEETWGKPSWGPNIKEFKHRFDPVETKGEGPRRLKNLYFLYLIELRALSKVAPYFERSIVDLYTGNAEEDADTKTLLLNIFQDTKSFPMHFDEKSMFAGDKKGAKSLKEEFRLHFKNISRIMDCVGCDKCRLWGKLQTQGLGTALKILFSEKEIQKLPENSPSKGFQLTRQEIVALLNAFGRLSTSIRDLQNFKVLLQHSR

SEQ ID NO: 10115 - protein, 71 aa, Artificial Sequence
  Description of Artificial Sequence: Synthetic coding sequence
MANNTKELEDCEQANKLGAINSTLSNQSKEAFIDWARYDDSRDHFCELDDERSPAAQYVDLLLNPERYTGY

SEQ ID NO: 10116 - protein, 233 aa, Artificial Sequence
  Description of Artificial Sequence: Synthetic coding sequence
MELPTKPGTFDLGLATWSPSFQGETHRAQARRRDVGRQLPEYKAVVVGASGVGKSALTIQLNHQCFVEDHDPTIQDSYWKELTLDSGDCILNVLDTAGQAIHRALRDQCLAVCDGVLGVFALDDPSSLIQLQQIWATWGPHPAQPLVLVGNKCDLVTTAGDAHAAAAALAHSWGAHFVETSAKTRQGVEEAFSLLVHEIQRVQEAMAKEPMARSCREKTRHQKATCHCGCSVA

SEQ ID NO: 10117 - protein, 725 aa, Artificial Sequence
  Description of Artificial Sequence: Synthetic coding sequence
MAMAMSDSGASRLRRQLESGGFEARLYVKQLSQQSDGDRDLQEHRQRIQALAEETAQNLKRNVYQNYRQFIETAREISYLESEMYQLSHLLTEQKSSLESIPLTLLPAAAAAGAAAASGGEEGVGGAGGRDHLRGQAGFFSTPGGASRDGSGPGEEGKQRTLTTLLEKVEGCRHLLETPGQYLVYNGDLVEYDADHMAQLQRVHGFLMNDCLLVATWLPQRRGMYRYNALYSLDGLAVVNVKDNPPMKDMFKLLMFPESRIFQAENAKIKREWLEVLEDTKRALSEKRRREQEEAAAPRGPPQVTSKATNPFEDDEEEEPAVPEVEEEKVDLSMEWIQELPEDLDVCIAQRDFEGAVDLLDKLNHYLEDKPSPPPVKELRAKVEERVRQLTEVLVFELSPDRSLRGGPKATRRAVSQLIRLGQCTKACELFLRNRAAAVHTAIRQLRIEGATLLYIHKLCHVFFTSLLETAREFEIDFAGTDSGCYSAFVVWARSAMGMFVDAFSKQVFDSKESLSTAAECVKVAKEHCQQLGDIGLDLTFIIHALLVKDIQGALHSYKEIIIEATKHRNSEEMWRRMNLMTPEALGKLKEEMKSCGVSNFEQYTGDDCWVNLSYTVVAFTKQTMGFLEEALKLYFPELHMVLLESLVEIILVAVQHVDYSLRCEQDPEKKAFIRQNASFLYETVLPVVEKRFEEGVGKPAKQLQDLRNASRLIRVNPESTTSVV

SEQ ID NO: 10118 - protein, 721 aa, Artificial Sequence
  Description of Artificial Sequence: Synthetic coding sequence
MSDSGASRLRRQLESGGFEARLYVKQLSQQSDGDRDLQEHRQRIQALAEETAQNLKRNVYQNYRQFIETAREISYLESEMYQLSHLLTEQKSSLESIPLTLLPAAAAAGAAAASGGEEGVGGAGGRDHLRGQAGFFSTPGGASRDGSGPGEEGKQRTLTTLLEKVEGCRHLLETPGQYLVYNGDLVEYDADHMAQLQRVHGFLMNDCLLVATWLPQRRGMYRYNALYSLDGLAVVNVKDNPPMKDMFKLLMFPESRIFQAENAKIKREWLEVLEDTKRALSEKRRREQEEAAAPRGPPQVTSKATNPFEDDEEEEPAVPEVEEEKVDLSMEWIQELPEDLDVCIAQRDFEGAVDLLDKLNHYLEDKPSPPPVKELRAKVEERVRQLTEVLVFELSPDRSLRGGPKATRRAVSQLIRLGQCTKACELFLRNRAAAVHTAIRQLRIEGATLLYIHKLCHVFFTSLLETAREFEIDFAGTDSGCYSAFVVWARSAMGMFVDAFSKQVFDSKESLSTAAECVKVAKEHCQQLGDIGLDLTFIIHALLVKDIQGALHSYKEIIIEATKHRNSEEMWRRMNLMTPEALGKLKEEMKSCGVSNFEQYTGDDCWVNLSYTVVAFTKQTMGFLEEALKLYFPELHMVLLESLVEIILVAVQHVDYSLRCEQDPEKKAFIRQNASFLYETVLPVVEKRFEEGVGKPAKQLQDLRNASRLIRVNPESTTSVV

SEQ ID NO: 10119 - protein, 1114 aa, Artificial Sequence
  Description of Artificial Sequence: Synthetic coding sequence
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPMVTSELYPPQLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 10120 - protein, 1104 aa, Artificial Sequence
  Description of Artificial Sequence: Synthetic coding sequence
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 10121 - protein, 1058 aa, Artificial Sequence
  Description of Artificial Sequence: Synthetic coding sequence
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 10122 - protein, 1114 aa, Artificial Sequence; identical to SEQ ID NO: 10119
  Description of Artificial Sequence: Synthetic coding sequence

SEQ ID NO: 10123 - protein, 886 aa, Artificial Sequence
  Description of Artificial Sequence: Synthetic coding sequence
MRAEEPCAPGAPSALGAQRTPGPELRLSSQLLPELCTFVVRVLFYLGPVYLAGYLGLSITWLLLGALLWMWWRRNRRGKLGRLAAAFEFLDNEREFISRELRGQHLPAWIHFPDVERVEWANKIISQTWPYLSMIMESKFREKLEPKIREKSIHLRTFTFTKLYFGQKCPRVNGVKAHTNTCNRRRVTVDLQICYIGDCEISVELQKIQAGVNGIQLQGTLRVILEPLLVDKPFVGAVTVFFLQKPHLQINWTGLTNLLDAPGINDVSDSLLEDLIATHLVLPNRVTVPVKKGLDLTNLRFPLPCGVIRVHLLEAEQLAQKDNFLGLRGKSDPYAKVSIGLQHFRSRTIYRNLNPTWNEVFEFMVYEVPGQDLEVDLYDEDTDRDDFLGSLQICLGDVMTNRVVDEWFVLNDTTSGRLHLRLEWLSLLTDQEVLTEDHGGLSTAILVVFLESACNLPRNPFDYLNGEYRAKKLSRFARNKVSKDPSSYVKLSVGKKTHTSKTCPHNKDPVWSQVFSFFVHNVATERLHLKVLDDDQECALGMLEVPLCQILPYADLTLEQRFQLDHSGLDSLISMRLVLRFLQVEERELGSPYTGPEALKKGPLLIKKVATNQGPKAQPQEEGPTDLPCPPDPASDTKDVSRSTTTTTSATTVATEPTSQETGPEPKGKDSAKRFCEPIGEKKSPATIFLTVPGPHSPGPIKSPRPMKCPASPFAWPPKRLAPSMSSLNSLASSCFDLADISLNIEGGDLRRRQLGEIQLTVRYVCLRRCLSVLINGCRNLTPCTSSGADPYVRVYLLPERKWACRKKTSVKRKTLEPLFDETFEFFVPMEEVKKRSLDVAVKNSRPLGSHRRKELGKVLIDLSKEDLIKGFSQWYELTPNGQPRS

SEQ ID NO: 10124 - protein, 820 aa, Artificial Sequence
  Description of Artificial Sequence: Synthetic coding sequence
MLRLGLCAAALLCVCRPGAVRADCWLIEGDKGYVWLAICSQNQPPYETIPQHINSTVHDLRLNENKLKAVLYSSLNRFGNLTDLNLTKNEISYIEDGAFLGQSSLQVLQLGYNKLSNLTEGMLRGMSRLQFLFVQHNLIEVVTPTAFSECPSLISIDLSSNRLSRLDGATFASLASLMVCELAGNPFNCECDLFGFLAWLVVFNNVTKNYDRLQCESPREFAGYPLLVPRPYHSLNAITVLQAKCRNGSLPARPVSHPTPYSTDAQREPDENSGFNPDEILSVEPPASSTTDASAGPAIKLHHVTFTSATLVVIIPHPYSKMYILVQYNNSYFSDVMTLKNKKEIVTLDKLRAHTEYTFCVTSLRNSRRFNHTCLTFTTRDPVPGDLAPSTSTTTHYIMTILGCLFGMVIVLGAVYYCLRKRRMQEEKQKSVNVKKTILEMRYGADVDAGSIVHAAQKLGEPPVLPVSRMASIPSMIGEKLPTAKGLEAGLDTPKVATKGNYIEVRTGAGGDGLARPEDDLPDLENGQGSAAEISTIAKEVDKVNQIINNCIDALKLDSASFLGGGSSSGDPELAFECQSLPAAAAASSATGPGALERPSFLSPPYKESSHHPLQRQLSADAAVTRKTCSVSSSGSIKSAKVFSLDVPDHPAATGLAKGDSKYIEKGSPLNSPLDRLPLVPAGSGGGSGGGGGIHHLEVKPAYHCSEHRHSFPALYYEEGADSLSQRVSFLKPLTRSKRDSTYSQLSPRHYYSGYSSSPEYSSESTHKIWERFRPYKKHHREEVYMAAGHALRKKVQFAKDEDLHDILDYWKGVSAQQKL

SEQ ID NO: 10125 - protein, 820 aa, Artificial Sequence; identical to SEQ ID NO: 10124
  Description of Artificial Sequence: Synthetic coding sequence

SEQ ID NO: 10126 - protein, 185 aa, Artificial Sequence
  Description of Artificial Sequence: Synthetic coding sequence
MVGLRWWNHIDEDGKSHWVFESRKESSQENKTVSEAESRIFWLGLIACSVLWVIFAFSALFSFTVKWLAVVIMGVVLQGANLYGYIRCKVRSRKHLTSMATSYFGKQFLRQRRSRHIAQTGLKVLGSRDPPASAFQSAGITGVSRCPGHPSRKFHQDSQKTLDFPGSYLKNMTPGRPMSPIPLRQ

SEQ ID NO: 10127 - protein, 357 aa, Artificial Sequence
  Description of Artificial Sequence: Synthetic coding sequence
MDSVEKTTNRSEQKSRKFLKSLIRKQPQELLLVIGTGVSAAVAPGIPALCSWRSCIEAVIEAAEQLEVLHPGDVAEFRRKVTKDRDLLVVAHDLIRKMSPRTGDAKPSFFQDCLMEVFDDLEQHIRSPVVLQSILSLMDRGAMVLTTNYDNLLEAFGRRQNKPMESLDLKDKTKVLEWARGHMKYGVLHIHGLYTDPCGVVLDPSGYKDVTQDAEVMEVLQNLYRTKSFLFVGCGETLRDQIFQALFLYSVPNKVDLEHYMLVLKENEDHFFKHQADMLLHGIKVVSYGDCFDHFPGYVQDLATQICKQQSPDADRVDSTTLLGNACQDCAKRKLEENGIEVSKKRTQSDTDDAGGS

SEQ ID NO: 10128 - protein, 175 aa, Artificial Sequence
  Description of Artificial Sequence: Synthetic coding sequence
MKYGVLHIHGLYTDPCGVVLDPSGYKDVTQDAEVMEVLQNLYRTKSFLFVGCGETLRDQIFQALFLYSVPNKVDLEHYMLVLKENEDHFFKHQADMLLHGIKVVSYGDCFDHFPGYVQDLATQICKQQSPDADRVDSTTLLGNACQDCAKRKLEENGIEVSKKRTQSDTDDAGGS

SEQ ID NO: 10129 - protein, 139 aa, Artificial Sequence
  Description of Artificial Sequence: Synthetic coding sequence
MDSVEKTTNRSEQKSRKFLKSLIRKQPQELLLVIGTGVSAAVAPGIPALCSWRSCIEAVIEAAEQLEVLHPGDVAEFRRKVTKDRDLLVVAHDLIRKMSPRTGDAKPSFFQDCLMEVFDDLEQHIRSPVVLQSILSLMD

SEQ ID NO: 10130 - protein, 357 aa, Artificial Sequence; identical to SEQ ID NO: 10127
  Description of Artificial Sequence: Synthetic coding sequence

SEQ ID NO: 10131 - protein, 273 aa, Artificial Sequence
  Description of Artificial Sequence: Synthetic coding sequence
MDPVPGTDSAPLAGLAWSSASAPPPRGFSAISCTVEGAPASFGKSFAQKSGYFLCLSSLGSLENPQENVVADIQIVVDKSPLPLGFSPVCDPMDSKASVSKKKRMCVKLLPLGATDTAVFDVRLSGKTKTVPGYLRIGDMGGFAIWCKKAKAPRPVPKPRGLSRDMQGLSLDAASQPSKGGLLERTASRLGSRASTLRRNDSIYEASSLYGISAMDGVPFTLHPRFEGKSCSPLAFSAFGDLTIKSLADIEEEYNYGFVVEKTAAARLPPSVS

SEQ ID NO: 10132 - protein, 233 aa, Artificial Sequence
  Description of Artificial Sequence: Synthetic coding sequence
MDPVPGTDSAPLAGLAWSSASAPPPRGFSAISCTVEGAPASFGKSFAQKSGYFLCLSSLGSLENPQENVVADIQIVVDKSPLPLGFSPVCDPMDSKASVSKKKRMCVKLLPLGATDTAVFDVRLSGKTKTVPGYLRIGKGGLLERTASRLGSRASTLRRNDSIYEASSLYGISAMDGVPFTLHPRFEGKSCSPLAFSAFGDLTIKSLADIEEEYNYGFVVEKTAAARLPPSVS

SEQ ID NO: 10133 - protein, 273 aa, Artificial Sequence; identical to SEQ ID NO: 10131
  Description of Artificial Sequence: Synthetic coding sequence

SEQ ID NO: 10134 - protein, 319 aa, Artificial Sequence
  Description of Artificial Sequence: Synthetic coding sequence
MRSCFCVRRSRDPPPPQPPPPPPQRGTDQSTMPEVKDLSEALPETSMDPITGVGVVASRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLPRHISLTLPATFRGRNSTRTDYEYQHSNLYAISAMDGVPFMISEKFSCVPESMQPFDLLGITIKSLAEIEKEYEYSFRTEQSAAARLPPSPTRCQQIPQS

SEQ ID NO: 10135 - protein, 205 aa, Artificial Sequence
  Description of Artificial Sequence: Synthetic coding sequence
MDTGLSSQPSEEDQSTMPEVKDLSEALPETSMDPITGVGVVASRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLP

SEQ ID NO: 10136 - protein, 304 aa, Artificial Sequence
  Description of Artificial Sequence: Synthetic coding sequence
MDTGLSSQPSEEDQSTMPEVKDLSEALPETSMDPITGVGVVASRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLPRHISLTLPATFRGRNSTRTDYEYQHSNLYAISAMDGVPFMISEKFSCVPESMQPFDLLGITIKSLAEIEKEYEYSFRTEQSAAARLPPSPTRCQQIPQS

SEQ ID NO: 10137 - protein, 214 aa, Artificial Sequence
  Description of Artificial Sequence: Synthetic coding sequence
MEAPAHGLEPCGWGACWLVCYTVGRRAGSWLRSWAGPPWRFPETKPSVSSVQGRRLEARRRVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLPR

SEQ ID NO: 10138 - protein, 221 aa, Artificial Sequence
  Description of Artificial Sequence: Synthetic coding sequence
MRSCFCVRRSRDPPPPQPPPPPPQRGTDQSTMPEVKDLSEALPETSMDPITGVGVVASRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLPR

SEQ ID NO: 10139 - protein, 928 aa, Artificial Sequence
  Description of Artificial Sequence: Synthetic coding sequence
MGGSASSQLDEGKCAYIRGKTEAAIKNFSPYYSRQYSVAFCNHVRTEVEQQRDLTSQFLKTKPPLAPGTILYEAELSQFSEDIKKWKERYVVVKNDYAVESYENKEAYQRGAAPKCRILPAGGKVLTSEDEYNLLSDRHFPDPLASSEKENTQPFVVLPKEFPVYLWQPFFRHGYFCFHEAADQKRFSALLSDCVRHLNHDYMKQMTFEAQAFLEAVQFFRQEKGHYGSWEMITGDEIQILSNLVMEELLPTLQTDLLPKMKGKKNDRKRTWLGLLEEAYTLVQHQVSEGLSALKEECRALTKGLEGTIRSDMDQIVNSKNYLIGKIKAMVAQPAEKSCLESVQPFLASILEELMGPVSSGFSEVRVLFEKEVNEVSQNFQTTKDSVQLKEHLDRLMNLPLHSVKMEPCYTKVNLLHERLQDLKSRFRFPHIDLVVQRTQNYMQELMENAVFTFEQLLSPHLQGEASKTAVAIEKVKLRVLKQYDYDSSTIRKKIFQEALVQITLPTVQKALASTCKPELQKYEQFIFADHTNMIHVENVYEEILHQILLDETLKVIKEAAILKKHNLFEDNMALPSESVSSLTDLKPPTGSNQASPARRASAILPGVLGSETLSNEVFQESEEEKQPEVPSSLAKGESLSLPGPSPPPDGTEQVIISRVDDPVVNPVATEDTAGLPGTCSSELEFGGTLEDEEPAQEEPEPITASGSLKALRKLLTASVEVPVDSAPVMEEDTNGESHVPQENEEEEEKEPSQAAAIHPDNCEESEVSEREAQPPCPEAHGEELGGFPEVGSPASPPASGGLTEEPLGPMEGELPGEACTLTAHEGRGGKCTEEGDASQQEGCTLGSDPICLSESQVSEEQEEMGGQSSAAQATASVNAEEIKVARIHECQWVVEDAPNPDVLLSHKDDVKEGEGGQESFPELPSEE

SEQ ID NO: 10140 - protein, 100 aa, Artificial Sequence
  Description of Artificial Sequence: Synthetic coding sequence
  MOD_RES (1)..(1): Any amino acid
XAVAIEKVKLRVLKQYDYDSSTIRKKIFQEALVQITLPTVQKALASTCKPELQKYEQFIFADHTNMIHVENVYEEILHQILLDETLKGAYIPIKCSSLKS

SEQ ID NO: 10141 - protein, 543 aa, Artificial Sequence
  Description of Artificial Sequence: Synthetic coding sequence
MASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFQIHLQELLQYKRQNPAQFCVRVCSGCAVLAVLGHYVPGIMISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETVSGGLTALPGTLSPPLCLVGSDPAPSPSILPPVPQDSPQPLPAPEEEEALTTEDFELLDQGELEQLNAELGLEPETPPKPPDAPPLGPDIHSLVQSDQEAQAVAEP

SEQ ID NO: 10142 - protein, 301 aa, Artificial Sequence
  Description of Artificial Sequence: Synthetic coding sequence
MISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETDSPQPLPAPEEEEALTTEDFELLDQGELEQLNAELGLEPETPPKPPDAPPLGPDIHSLVQSDQEAQAVAEP

SEQ ID NO: 10143 - protein, 466 aa, Artificial Sequence
  Description of Artificial Sequence: Synthetic coding sequence
MAEAEGVPTTPGPASGSTFRGRRDVSGSWERDQQVEAAQRALVEVLGPYEPLLSRVQAALVWERPARSALWCLGLNAAFWFFALTSLRLVFLLAFGLMIIVCIDQWKNKIWPEIKVPRPDALDNESWGFVHPRLLSVPELCHHVAEVWVSGTIFIRNVLLFKKQNPGKFCLLSCGILTFLAVLGRYVPGLLLSYLMLVTVMMWPLAVYHRLWDRAYVRLKPALQRLDFSVRGYMMSKQRERQLRRRALHPERAMDNHSDSEEELAAFCPQLDDSTVARELAITDSEHSDAEVSCTDNGTFNLSRGQTPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 10144 - protein, 271 aa, Artificial Sequence
  Description of Artificial Sequence: Synthetic coding sequence
MLVTVMMWPLAVYHRLWDRAYVRLKPALQRLDFSVRGYMMSKQRERQLRRRALHPERAMDNHSDSEEELAAFCPQLDDSTVARELAITDSEHSDAEVSCTDNGTFNLSRGQTPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 10145 - protein, 1319 aa, Artificial Sequence
  Description of Artificial Sequence: Synthetic coding sequence
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 10146 - protein, 1302 aa, Artificial Sequence
  Description of Artificial Sequence: Synthetic coding sequence
MTEVQAMVEFSVELNKFYNVDLFQRGKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELAKANMQLLYERLLRRKQLRTQKDNHLEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 10147 - protein, 1515 aa, Artificial Sequence
  Description of Artificial Sequence: Synthetic coding sequence
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 10148 - protein, 1302 aa, Artificial Sequence; identical to SEQ ID NO: 10146
  Description of Artificial Sequence: Synthetic coding sequence

SEQ ID NO: 10149 - protein, 50 aa, Artificial Sequence
  Description of Artificial Sequence: Synthetic coding sequence
MTEVQAMVEFSVELNKFYNVDLFQRGFYQIRASMKIPSRIPHRVEASLLH

SEQ ID NO: 10150 - protein, 31 aa, Artificial Sequence
  Description of Artificial Sequence: Synthetic coding sequence
MTEVQAMVEFSVELNKFYNVDLFQRGFYQIR

SEQ ID NO: 10151 - protein, 505 aa, Artificial Sequence
  Description of Artificial Sequence: Synthetic coding sequence
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSEN

SEQ ID NO: 10152 - protein, 153 aa, Artificial Sequence
  Description of Artificial Sequence: Synthetic coding sequence
MSEIQGTVEFSVELHKFYNVDLFQRGYYQIRVTLKVSSRIPHRLSASIAGQTESSSLHSACVHDSTVHSRVFQILYRNEEVPINDAVVFRVHLLLGGERMEDALSEVDFQLKVDLHFTDSEQQLRDVAGAPMVSSRTLGLHFHPRNGLHHQVP

SEQ ID NO: 10153 - protein, 1406 aa, Artificial Sequence
  Description of Artificial Sequence: Synthetic coding sequence
MSEIQGTVEFSVELHKFYNVDLFQRGYYQIRVTLKVSSRIPHRLSASIAGQTESSSLHSACVHDSTVHSRVFQILYRNEEVPINDAVVFRVHLLLGGERMEDALSEVDFQLKVDLHFTDSEQQLRDVAGAPMVSSRTLGLHFHPRNGLHHQVPVMFDYFHLSVISVTVHAALVALQQPLISFTRPGRGSWLGKGGPDTGQEQSIISLENLVFGAGYCKPTSSEGSFYITSENCMQHAHKWHRDLCLLLLHAYRGLRLHFLVIMRDIPELPHTELEALAVEETLSQLCSELQMLNNPEKIAEQISKDLAWLTSHMMTLWTQFLDTVTLHSQVTTYLTQEHHTLRVRRFSEAFFYMEHQKLAVLTFQENLIQTHSQLSLDIRNSEYLTSMPPLPAECLDIDGDWNTLPVIFEDRYVDCPATGHNLSVYPNFDVPVTSPTIMNLKDKEDNCMVNSNLSFREDLVLSTIKPSQMDSDEEVIRCPEPGENVATQNHMDMCSESQVYISIGEFQNKAGVPEDECWTGQTSDAGTYPVADVDTSRRSPGPEDGQAPVLTYIDVKSSNKNPSRAEPLVAFNAQHESRSSRDKYGLDRTGLSKVVVGGSHQNAISSDKTTLHELSTLGKGIDQEGKMVLLSLKLTPSEPCDPLSSTLREPLDIRSSLKDSHTEEQEELSVLSGVIKRSSSIISDSGIESEPSSVAWSEARSRALELPSDREVLHPFVRRHALHRNSLEGGHTESNTSLPSGIQASLTSISSLPFEEDEREVALTKLTKSVSAPHISSPEEAAEDADTKQQDGGFAEPSDMHSKSQGSPGSCSQLCGDSGTDAGADHPLVEIVLDADNQQGPGYIDIPKGKGKQFDAQGHCLPDGRTENTPGVETKGLNLKIPRVIALENPRTRSLHRALEETPKGMPKDLNVGQQALSNSGISEVEGLSQHQVPELSCTSAADAINRNSTGQQSQSGSPCIMDDTAFNRGVNAFPEAKHKAGTVCPTVTHSVHSQVLKNQELKAGTSIMGSHLTSAETFTLDSLKAVEVVNLSVSCTATCLPFSSVPKETPARAGFSSKQTLFPITHQPLGSFGVVSTHSSTLDEEVSERMFSFYQAKEKFKKELKIEGFLYSDLTVLASDIPYFPPEEEEENLEDGIHLVVCVHGLDGNSADLRLVKTFIELGLPGGKLDFLMSEKNQMDTFADFDTMTDRLLDEIIQHIQLYNLSISRISFIGHSLGNIIIRSVLTRPRFRYYLNKLHTFLSLSGPHLGTLYNNSTLVSTGLWLMQKLKKSGSLLQLTFRDNADLRKCFLYQLSQKTGLQYFKNVVLVASPQDRYVPFHSARIEMCKTALKDRHTGPVYAEMINNLLGPLVEAKDCTLIRHNVFHALPNTANTLIGRAAHIAVLDSELFLEKFFLVAGLNYFK

SEQ ID NO: 10154 - protein, 68 aa, Artificial Sequence
  Description of Artificial Sequence: Synthetic coding sequence
MSEIQGTVEFSVELHKFYNVDLFQRGYYQIRVTLKVSSRIPHRLSASIAGQTEVLNIHMSEQEPAQGK

SEQ ID NO: 10155 - protein, 398 aa, Artificial Sequence
  Description of Artificial Sequence: Synthetic coding sequence
MVCREQLSKNQVKWVFAGITCVSVVVIAAIVLAITLRRPGCELEACSPDADMLDYLLSLGQISRRDALEVTWYHAANSKKAMTAALNSNITVLEADVNVEGLGTANETGVPIMAHPPTIYSDNTLEQWLDAVLGSSQKGIKLDFKNIKAVGPSLDLLRQLTEEGKVRRPIWINADILKGPNMLISTEVNATQFLALVQEKYPKATLSPGWTTFYMSTSPNRTYTQAMVEKMHELVGGVPQRVTFPVRSSMVRAAWPHFSWLLSQSERYSLTLWQAASDPMSVEDLLYVRDNTAVHQVYYDIFEPLLLTDMLELCQGLWQPVSFQMQAMLLGHSTAGAIGRLLASSPRATVTVEHNPAGGDYASVRTALLAARAVDRTRVYYRLPQGYHKDLLAHVGRN

SEQ ID NO: 10156 - protein, 585 aa, Artificial Sequence
  Description of Artificial Sequence: Synthetic coding sequence
MVCREQLSKNQVKWVFAGITCVSVVVIAAIVLAITLRRPGCELEACSPDADMLDYLLSLGQISRRDALEVTWYHAANSKKAMTAALNSNITVLEADVNVEGLGTANETGVPIMAHPPTIYSDNTLEQWLDAVLGSSQKGIKLDFKNIKAVGPSLDLLRQLTEEGKVRRPIWINADILKGPNMLISTEVNATQFLALVQEKYPKATLSPGWTTFYMSTSPNRTYTQAMVEKMHELVGGVPQRVTFPVRSSMVRAAWPHFSWLLSQSERYSLTLWQAASDPMSVEDLLYVRDNTAVHQVYYDIFEPLLSQFKQLALNATRKPMYYTGGSLIPLLQLPGDDGLNVEWLVPDVQGSGKTATMTLPDTEGMILLNTGLEGTVAENPVPIVHTPSGNILTLESCLQQLATHPGHWGIHLQIAEPAALRPSLALLARLSSLGLLHWPVWVGAKISHGSFSVPGHVAGRELLTAVAEVFPHVTVAPGWPEEVLGSGYREQLLTDMLELCQGLWQPVSFQMQAMLLGHSTAGAIGRLLASSPRATVTVEHNPAGGDYASVRTALLAARAVDRTRVYYRLPQGYHKDLLAHVGRN

SEQ ID NO: 10157 - protein, 311 aa, Artificial Sequence
  Description of Artificial Sequence: Synthetic coding sequence
MVCREQLSKNQVKWVFAGITCVSVVVIAAIVLAITLRRPGCELEACSPDADMLDYLLSLGQISRRDALEVTWYHAANSKKAMTAALNSNITVLEADVNVEGLGTANETGVPIMAHPPTIYSDNTLEQWLDAVLGSSQKGIKLDFKNIKAVGPSLDLLRQLTEEGKVRRPIWINADILKGPNMLISTEVNATQFLALVQEKYPKATLSPGWTTFYMSTSPNRTYTQAMVEKMHELVGGVPQRVTFPVRSSMVRAAWPHFSWLLSQSERYSLTLWQAASDPMSVEDLLYVRDNTAVHQVYYDIFEPLLCSQIC

SEQ ID NO: 10158 - protein, 458 aa, Artificial Sequence
  Description of Artificial Sequence: Synthetic coding sequence
MTRGAWMCRQYDDGLKIWLAAPRENEKPFIDSERAQKWRLSLASLLFFTVLLSDHLWFCAEAKLTRARDKEHQQQQRQQQQQQQQQRQRQQQQQQRRQQEPSWPALLASMGESSPAAQAHRLLSASSSPTLPPSPGDGGGGGGKGNRGKDDRGKALFLGNSAKPVWRLETCYPQGASSGQCFTVENADAVCARNWSRGAAGGDGQEVRSKHPTPLWNLSDFYLSFCNSYTLWELFSGLSSPNTLNCSLDVVLKEGGEMTTCRQCVEAYQDYDHHAQEKYEEFESVLHKYLQSEEYSVKSCPEDCKIVYKAWLCSQYFEVTQFNCRKTIPCKQYCLEVQTRCPFILPDNDEVIYGGLSSFICTGLYETFLTNDEPECCDVRREEKSNNPSKGTVEKSGSCHRTSLTVSSATRLCNSRLKLCVLVLILLHTVLTASAAQNTAGLSFGGINTLEENSTNEE

SEQ ID NO: 10159 - protein, 472 aa, Artificial Sequence
  Description of Artificial Sequence: Synthetic coding sequence
MFRGAWMWPGKDAAALTICCCCCCWAPRPSDKPCADSERAQRWRLSLASLLFFTVLLADHLWLCAGARPRARELSSAMRPPWGAGRERQPVPPRAVLPLPPPPPGEPSAPPGTCGPRYSNLTKAAPAAGSRPVCGGVPEPTGLDAACTKLQSLQRLFEPTTPAPPLRPPDSLSRAPAEFPSAKKNLLKGHFRNFTLSFCDTYTVWDLLLGMDRPDSLDCSLDTLMGDLLAVVASPGSGAWEACSNCIEAYQRLDRHAQEKYDEFDLVLHKYLQAEEYSIRSCTKGCKAVYKAWLCSEYFSVTQQECQRWVPCKQYCLEVQTRCPFILPDNEEMVYGGLPGFICTGLLDTSPKRLETKCCDVQWVSCEAKKKKFKESEAPKTHQQQFHHSYFHHYHQQYHHYHPHHDPPGRVSNKPALLPVSGGSRLSPSRIRLCVLVLMLLHTVVSFSSNQGGGGLGLETLPALEEGLTREE

SEQ ID NO: 10160 - protein, 213 aa, Artificial Sequence
  Description of Artificial Sequence: Synthetic coding sequence
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYCQSHRPNLSGIPGESNRAPHPSSWETLVQGLSGLTLSLGTNQPGPLPEAALQPQETEEKRQRERQQESKIMFQRLLKQWLEEN

SEQ ID NO: 10161 - protein, 213 aa, Artificial Sequence; identical to SEQ ID NO: 10160
  Description of Artificial Sequence: Synthetic coding sequence

SEQ ID NO: 10162 - protein, 213 aa, Artificial Sequence; identical to SEQ ID NO: 10160
  Description of Artificial Sequence: Synthetic coding sequence

SEQ ID NO: 10163 - protein, 126 aa, Artificial Sequence
  Description of Artificial Sequence: Synthetic coding sequence
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRC

SEQ ID NO: 10164 - protein, 184 aa, Artificial Sequence
  Description of Artificial Sequence: Synthetic coding sequence
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYCQSHRPNLSGIPGESNRAPHPSSWETLVQGLSGLTLSLGTNQPGPLPEAALQPQ

SEQ ID NO: 10165 - protein, 213 aa, Artificial Sequence; identical to SEQ ID NO: 10160
  Description of Artificial Sequence: Synthetic coding sequence

SEQ ID NO: 10166 - protein, 10 aa, Artificial Sequence
  Description of Artificial Sequence: Synthetic coding sequence
MDPLQKRNPA

SEQ ID NO: 10167 - protein, 188 aa, Artificial Sequence
  Description of Artificial Sequence: Synthetic coding sequence
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYCQSHRPNLSGIPGESNRAPHPSSWETLVQGLSGLTLSLGTNQPGPLPEAALQPQETEE

SEQ ID NO: 10168 - protein, 108 aa, Artificial Sequence
  Description of Artificial Sequence: Synthetic coding sequence
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVG

SEQ ID NO: 10169 - protein, 111 aa, Artificial Sequence
  Description of Artificial Sequence: Synthetic coding sequence
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREA

SEQ ID NO: 10170 - protein, 131 aa, Artificial Sequence
  Description of Artificial Sequence: Synthetic coding sequence
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYC

SEQ ID NO: 10171 - protein, 3 aa, Artificial Sequence
  Description of Artificial Sequence: Synthetic coding sequence
MDP

SEQ ID NO: 10172 - protein, 85 aa, Artificial Sequence
  Description of Artificial Sequence: Synthetic coding sequence
MDPLQKRNPASPSKSSPMTAAETSQEGPAPSQPSYSEQPMMGLSNLSPGPGPSQAVPLPEGLLRQRYREEKTLEERRWERLEFLQ

SEQ ID NO: 10173 - protein, 213 aa, Artificial Sequence; identical to SEQ ID NO: 10160
  Description of Artificial Sequence: Synthetic coding sequence

SEQ ID NO: 10174 - protein, 213 aa, Artificial Sequence; identical to SEQ ID NO: 10160
  Description of Artificial Sequence: Synthetic coding sequence

SEQ ID NO: 10175 - protein, 213 aa, Artificial Sequence; identical to SEQ ID NO: 10160
  Description of Artificial Sequence: Synthetic coding sequence

SEQ ID NO: 10176 - protein, 213 aa, Artificial Sequence; identical to SEQ ID NO: 10160
  Description of Artificial Sequence: Synthetic coding sequence

SEQ ID NO: 10177 - protein, 213 aa, Artificial Sequence; identical to SEQ ID NO: 10160
  Description of Artificial Sequence: Synthetic coding sequence

SEQ ID NO: 10178 - protein, 213 aa, Artificial Sequence; identical to SEQ ID NO: 10160
  Description of Artificial Sequence: Synthetic coding sequence

SEQ ID NO: 10179 - protein, 213 aa, Artificial Sequence; identical to SEQ ID NO: 10160
  Description of Artificial Sequence: Synthetic coding sequence

SEQ ID NO: 10180 - protein, 190 aa, Artificial Sequence
  Description of Artificial Sequence: Synthetic coding sequence
MSGACTSYVSAEQEVVRGFSCPRPGGEAAAVFCCGFRDHKYCCDDPHSFFPYEHSYMWWLSIGALIGLSVAAVVLLAFIVTACVLCYLFISSKPHTKLDLGLSLQTAGPEEVSPDCQGVNTGMAAEVPKVSPLQQSYSCLNPQLESNEGQAVNSKRLLHHCFMATVTTSDIPGSPEEASVPNPDLCGPVP

SEQ ID NO: 10181 - protein, 169 aa, Artificial Sequence
  Description of Artificial Sequence: Synthetic coding sequence
MGSLSGLRLAAGSCFRLCERDVSSSLRLTRSSDLKRINGFCTKPQESPGAPSRHLQQSAFTQTYGLAEKDPHMVRSLQEDEIPETVSLEMLDAAKNKMRVKISYLMIALTVVGCIFWLLRARSCPKTRDFNKLELRKESSSERGSSYEGQNRVAEVSVLAILKIQELCY

SEQ ID NO: 10182 - protein, 154 aa, Artificial Sequence
  Description of Artificial Sequence: Synthetic coding sequence
MGSLSGLRLAAGSCFRLCERDVSSSLRLTRSSDLKRINGFCTKPQESPGAPSRTYNRVPLHKPTDWQKKILIWSGRFKKEDEIPETVSLEMLDAAKNKMRVKISYLMIALTVVGCIFMVIEGKKAAQRHETLTSLNLEKKARLKEEAAMKAKTE

SEQ ID NO: 10183 - protein, 162 aa, Artificial Sequence
  Description of Artificial Sequence: Synthetic coding sequence
MLRAVGSLLRLGRGLTVRCGPGAPLEATRRPAPALPPRGLPCYSSGGAPSNSGPQGHGEIHRVPTQRRPSQFDKKILLWTGRFKSMEEIPPRIPPEMIDTARNKARVKACYIMIGLTIIACFAVIVSAKRAVERHESLTSWNLAKKAKWREEAALAAQAKAK

SEQ ID NO: 10184 - protein, 167 aa, Artificial Sequence
  Description of Artificial Sequence: Synthetic coding sequence
MTAGTVVITGGILATVILLCIIAVLCYCRLQYYCCKKSGTEVADEEEEREHDLPTHPRGPTCNACSSQALDGRGSLAPLTSEPCSQPCGVAASHCTTCSPYSSPFYIRTADMVPNGGGGERLSFAPTYYKEGGPPSLKLAAPQSYPVTWPGSGREAFTNPRAISTDV

SEQ ID NO: 10185 - protein, 166 aa, Artificial Sequence
  Description of Artificial Sequence: Synthetic coding sequence
MTAGTVVITGGILATVILLCIIAVLCYCRLQYYCCKKDESEEDEEEPDFAVHSHLPPLHSNRNLVLTNGPALYPTASTSFSQKSPQARALCRSCSHCEPPTFFLQEPPEEEEDVLNGGERVLYKSVSQEDVELPPGGFGGLQALNPNRLSAMREAFARSRSISTDV

SEQ ID NO: 10186 - protein, 166 aa, Artificial Sequence; identical to SEQ ID NO: 10185
  Description of Artificial Sequence: Synthetic coding sequence

SEQ ID NO: 10187 - protein, 58 aa, Artificial Sequence
  Description of Artificial Sequence: Synthetic coding sequence
MNWKVLEHVHLLLYILAAKTLILCLAFAGVKIYQRKRLEAKQQKLEAERKKQSEKKDN

SEQ ID NO: 10188 - protein, 58 aa, Artificial Sequence
  Description of Artificial Sequence: Synthetic coding sequence
MNWKVLEHVPLLLYILAAKTLILCLTFAGVKMYQRKRLEAKQQKLEAERKKQSEKKDN

SEQ ID NO: 10189 - protein, 58 aa, Artificial Sequence; identical to SEQ ID NO: 10188
  Description of Artificial Sequence: Synthetic coding sequence

SEQ ID NO: 10190 - protein, 198 aa, Artificial Sequence
  Description of Artificial Sequence: Synthetic coding sequence
MSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGNSTRHDLTPVTAVSVHLLSSNGTPVLVDGPIYVTVPLATQSSLRHNAYVAAWRFDQKL

SEQ ID NO: 10191 - protein, 890 aa, Artificial Sequence
  Description of Artificial Sequence: Synthetic coding sequence
MSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGARPQPRVHFQRRALRLPENTSYSDLTAFLTAASSPSEVDSFPYLRGLDGNGTGNSTRHDLTPVTAVSVHLLSSNGTPVLVDGPIYVTVPLATQSSLRHNAYVAAWRFDQKLGTWLKSGLGLVHQEGSQLTWTYIAPQLGYWVAAMSPPIPGPVVTQDITTYHTVFLLAILGGMAFILLVLLCLLLYYCRRKCLKPRQHHRKLQLPAGLESSKRDQSTSMSHINLLFSRRASEFPGPLSVTSHGRPEAPGTKELMSGVHLEMMSPGGEGDLHTPMLKLSYSTSQEFSSREELLSCKEEDKSQISFDNLTPSGTLGKDYHKSVEVFPLKARKSMEREGYESSGNDDYRGSYNTVLSQPLFEKQDREGPASTGSKLTIQEHLYPAPSSPEKEQLLDRRPTECMMSRSVDHLERPTSFPRPGQLICCSSVDQVNDSVYRKVLPALVIPAHYMKLPGDHSYVSQPLVVPADQQLEIERLQAELSNPHAGIFPHPSSQIQPQPLSSQAISQQHLQDAGTREWSPQNASMSESLSIPASLNDAALAQMNSEVQLLTEKALMELGGGKPLPHPRAWFVSLDGRSNAHVRHSYIDLQRAGRNGSNDASLDSGVDMNEPKSARKGRGDALSLQQNYPPVQEHQQKEPRAPDSTAYTQLVYLDDVEQSGSECGTTVCTPEDSALRCLLEGSSRRSGGQLPSLQEETTRRTADAPSEPAASPHQRRSAHEEEEDDDDDDQGEDKKSPWQKREERPLMAFNIK

SEQ ID NO: 10192 - protein, 889 aa, Artificial Sequence
  Description of Artificial Sequence: Synthetic coding sequence
GGDEQVRDAAAVPAGLPRLEGGDTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGARPQPRVHFQRRALRLPENTSYSDLTAFLTAASSPSEVDSFPYLRGLDGNGTGNSTRHDLTPVTAVSVHLLSSNGTPVLVDGPIYVTVPLATQSSLRHNAYVAAWRFDQKLGTWLKSGLGLVHQEGSQLTWTYIAPQLGYWVAAMSPPIPGPVVTQDITTYHTVFLLAILGGMAFILLVLLCLLLYYCRRKCLKPRQHHRKLQLPAGLESSKRDQSTSMSHINLLFSRRASEFPGPLSVTSHGRPEAPGTKELMSGVHLEMMSPGGEGDLHTPMLKLSYSTSQEFSSREELLSCKEEDKSQISFDNLTPSGTLGKDYHKSVEVFPLKARKSMEREGYESSMMTTGVVTTPCSHSLYLKSRTEKVQPPREANSPFRNICTPRLHHLRKNSCWTADPLNMMSRSVDHLERPTSFPRPGQLICCSSVDQVNDSVYRKVLPALVIPAHYMKLPGDHSYVSQPLVVPADQQLEIERLQAELSNPHAGIFPHPSSQIQPQPLSSQAISQQHLQDAGTREWSPQNASMSESLSIPASLNDAALAQMNSEVQLLTEKALMELGGGKPLPHPRAWFVSLDGRSNAHVRHSYIDLQRAGRNGSNDASLDSGVDMNEPKSARKGRGDALSLQQNYPPVQEHQQKEPRAPDSTAYTQLVYLDDVEQSGSECGTTVCTPEDSALRCLLEGSSRRSGGQLPSLQEETTRRTADAPSEPAASPHQRRSAHEEEEDDDDDDQGEDKKSPWQKREERPLMAFNIK

SEQ ID NO: 10193 - protein, 198 aa, Artificial Sequence; identical to SEQ ID NO: 10190
  Description of Artificial Sequence: Synthetic coding sequence

SEQ ID NO: 10194 - protein, 826 aa, Artificial Sequence
  Description of Artificial Sequence: Synthetic coding sequence
MPPASGPSVLARLLPLLGLLLGSASRAPGKSPPEPPSPQEILIKVQVYVSGELVPLARASVDVFGNRTLLAAGTTDSEGVATLPLSYRLGTWVLVTAARPGFLTNSVPWRVDKLPLYASVSLYLLPERPATLILYEDLVHILLGSPGARSQPLVQFQRRAARLPVSSTYSQLWASLTPASTQQEMRAFPAFLGTEASSSGNGSWLELMPLTAVSVHLLTGNGTEVPLSGPIHLSLPVPSETRALTVGTSIPAWRFDPKSGLWVRNGTGVIRKEGRQLYWTFVSPQLGYWVAAMASPTAGLVTITSGIQDIGTYHTIFLLTILAALALLVLILLCLLIYYCRRRCLKPRQQHRKLQLSGPSDGNKRDQATSMSQLHLICGGPLEPAPSGDPEAPPPGPLHSAFSSSRDLASSRDDFFRTKPRSASRPAAEPSGARGGESAGLKGARSAEGPGGLEPGLEEHRRGPSGAAAFLHEPPSPPPPFDHYLGHKGAAEGKTPDFLLSQSVDQLARPPSLGQAGQLIFCGSIDHLKDNVYRNVMPTLVIPAHYVRLGGEAGAAGVGDEPAPPEGTAPGPARAFPQPDPQRPQMPGHSGPGGEGGGGGGEGWGAGRAAPVSGSVTIPVLFNESTMAQLNGELQALTEKKLLELGVKPHPRAWFVSLDGRSNSQVRHSYIDLQAGGGARSTDASLDSGVDVHEARPARRRPAREERERAPPAAPPPPPAPPRLALSEDTEPSSSESRTGLCSPEDNSLTPLLDEVAAPEGRAATVPRGRGRSRGDSSRSSASELRRDSLTSPEDELGAEVGDEAGDKKSPWQRREERPLMVFNVK

SEQ ID NO: 10195 - protein, 427 aa, Artificial Sequence
  Description of Artificial Sequence: Synthetic coding sequence
MARLCRRVPCTLLLGLAVVLLKARLVPAAARAELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWVNHGRGMVKEHNNHLIWTYDAPHLGYWIAAPLPGTRGSGINEDSKDITAYHTVFLTAILGGTIVIVIGFFAVLLCYCRDKCGTPQKRERNITKLEVLKRDQTTSTTHINHIRNRRKSFHGKNSGRF

SEQ ID NO: 10196 - protein, 826 aa, Artificial Sequence
  Description of Artificial Sequence: Synthetic coding sequence
MARLCRRVPCTLLLGLAVVLLKARLVPAAARAELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWVNHGRGMVKEHNNHLIWTYDAPHLGYWIAAPLPGTRGSGINEDSKDITAYHTVFLTAILGGTIVIVIGFFAVLLCYCRDKCGTPQKRERNITKLEVLKRDQTTSTTHINHISTVKVALKAEDKSQLFNAKNSSYSPQKKEPSKAETEERVSMVKTRDDFKIYNEDVSFLSVNQNNYSRNPTQSLEPNVGSKQPKHINNNLSSSLGDAQDEKRYLTGNEEAYGRSHIPEQLMHIYSQPIAILQTSDLFSTPEQLHTAKSATLPRKGQLVYGQLMEPVNRENFTQTLPKMPIHSHAQPPDAREEDIILEGQQSLPSQASDWSRYSSSLLESVSVPGTLNEAVVMTPFSSELQGISEQTLLELSKGKPSPHPRAWFVSLDGKPVAQVRHSFIDLKKGKRTQSNDTSLDSGVDMNELHSSRKLEREKTFIKSMHQPKILYLEDLDLSSSESGTTVCSPEDPALRHILDGGSGVIMEHPGEESPGRKSTVEDFEANTSPTKRRGRPPLAKRDSKTNIWKKREERPLIPIN

SEQ ID NO: 10197 - protein, 235 aa, Artificial Sequence
  Description of Artificial Sequence: Synthetic coding sequence
MEQDDPVEALTELRERRLGALELLQAAAGSGLAAYAVWALLLQPGFRRVPLRLQVPYVGASARQVEHVLSLLRGRPGKTVDLGSGDGRIVLAAHRCGLRPAVGYELNPWLVALARLHAWRAGCAGSVCYRRKDLWKVSLRDCRNVSVFLAPSVLPLLEDKLRTELPAGARVVSGRFPLPTWQPVTAVGEGLDRVWAYDVPEGGQAGEAASSRIPIQAAPGPSSAPIPGGLISQAS

SEQ ID NO: 10198 - protein, 235 aa, Artificial Sequence; identical to SEQ ID NO: 10197
  Description of Artificial Sequence: Synthetic coding sequence

SEQ ID NO: 10199 - protein, 233 aa, Artificial Sequence
  Description of Artificial Sequence: Synthetic coding sequence
MEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIAAAKKGFTAVGYELNPWLVWYSRYRAWREGVHGSAKFYISDLWKVTFSQYSNVVIFGVPQMMLQLEKKLERELEDDARVIACRFPFPHWTPDHVTGEGIDTVWAYDASTFRGREKRPCTSMHFQLPIQA

SEQ ID NO: 10200 - protein, 190 aa, Artificial Sequence
  Description of Artificial Sequence: Synthetic coding sequence
MKASQCCCCLSHLLASVLLLLLLPELSGPLAVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQRALTVLMVVSGAVLVYFVVRTVRMRRRNRKTRRYGVLDTNIENMELTPLEQDDEDDDNTLFDANHPRR

SEQ ID NO: 10201 - protein, 159 aa, Artificial Sequence
  Description of Artificial Sequence: Synthetic coding sequence
MRAVPLPAPLLPLLLLALLAAPAARASRAESVSAPWPEPERESRPPPGPGPGNTTRFGSGAAGGSGSSSSNSSGDALVTRISILLRDLPTLKAAVIVAFAFTTLLIACLLLRVFRSGKRLKKTRKYDIITTPAERVEMAPLNEEDDEDEDSTVFDIKYR

SEQ ID NO: 10202 - protein, 152 aa, Artificial Sequence
  Description of Artificial Sequence: Synthetic coding sequence
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEVPGTRSLNRYY

SEQ ID NO: 10203 - protein, 152 aa, Artificial Sequence; identical to SEQ ID NO: 10202
  Description of Artificial Sequence: Synthetic coding sequence

SEQ ID NO: 10204 - protein, 152 aa, Artificial Sequence; identical to SEQ ID NO: 10202
  Description of Artificial Sequence: Synthetic coding sequence

SEQ ID NO: 10205 - protein, 152 aa, Artificial Sequence; identical to SEQ ID NO: 10202
  Description of Artificial Sequence: Synthetic coding sequence

SEQ ID NO: 10206 - protein, 143 aa, Artificial Sequence
  Description of Artificial Sequence: Synthetic coding sequence
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEVP

SEQ ID NO: 10207 - protein, 101 aa, Artificial Sequence
  Description of Artificial Sequence: Synthetic coding sequence
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHR

SEQ ID NO: 10208 - protein, 203 aa, Artificial Sequence
  Description of Artificial Sequence: Synthetic coding sequence
MLQQDSNDDTEDVSLFDAEEETTNRPRKAKIRHPVASFFHLFFRVSAIIVCLLCELLSSSFITCMVTIILLLSCDFWAVKNVTGRLMVGLRWWNHIDEDGKSHWVFESRKESSQENKTVSEAESRIFWLGLIACSVLWVIFAFSALFSFTVKWLAVVIMGVVLQGANLYGYIRCKVRSRKHLTSMATSYFGKQFLRQVSVFWM

SEQ ID NO: 10209 - protein, 213 aa, Artificial Sequence
  Description of Artificial Sequence: Synthetic coding sequence
MKQALVDDTEDVSLDFGNEEELAFRKAKIRHPLATFFHLFFRVSAIVTYVSCDWFSKSFVGCFVMVLLLLSLDFWSVKNVTGRLLVGLRWWNQIDEDGKSHWIFEARKVSPNSIAATEAEARIFWLGLIICPMIWIVFFFSTLFSLKLKWLALVVAGISLQAANLYGYILCKMGGNSDIGKVTASFLSQTVFQTACPGDFQKPGLEGLEIHQH

SEQ ID NO: 10210 - protein, 188 aa, Artificial Sequence
  Description of Artificial Sequence: Synthetic coding sequence
MKQALVDDTEDVSLDFGNEEELAFRKAKIRDRVSKLLASVILLPWPPKVLGLKNVTGRLLVGLRWWNQIDEDGKSHWIFEARKVSPNSIAATEAEARIFWLGLIICPMIWIVFFFSTLFSLKLKWLALVVAGISLQAANLYGYILCKMGGNSDIGKVTASFLSQTVFQTACPGDFQKPGLEGLEIHQH

SEQ ID NO: 10211 - protein, 205 aa, Artificial Sequence
  Description of Artificial Sequence: Synthetic coding sequence
MLQQDSNDDTEDVSLFDAEEETTNRPRKAKIRHPVASFFHLFFRVSAIIVYLLCGLLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLAVVIMGVVLQGANLYGYIRCKVRSRKHLTSMATSYFGKQFLRQNTGDDQTS

SEQ ID NO: 10212 - protein, 276 aa, Artificial Sequence
  Description of Artificial Sequence: Synthetic coding sequence
MLQQDSNDDTEDVSLFDAEEETTNRPRKAKIRHPVASFFHLFFRVSAIIVCLLCELLSSSFITCMVTIILLLSCDFWAVKNVTGRLMVGLRWWNHIDEDGKSHWVFESRKESSQENKTVSEAESRIFWLGLIACSVLWVIFAFSALFSFTVKWLRRSRHIAQTGLKVLGSRDPPASAFQSAGITGVSRCPGHPSRKFHQVDINSFTRITDRALYWKPAPRLSSPPLRAAPGNCQQMAPARLFLSLRLWAWRGGGESPNSRGTGEPGPKFHLASGMH

SEQ ID NO: 10213 - protein, 203 aa, Artificial Sequence; identical to SEQ ID NO: 10208
  Description of Artificial Sequence: Synthetic coding sequence

SEQ ID NO: 10214 - protein, 185 aa, Artificial Sequence; identical to SEQ ID NO: 10126
  Description of Artificial Sequence: Synthetic coding sequence

SEQ ID NO: 10215 - protein, 369 aa, Artificial Sequence
  Description of Artificial Sequence: Synthetic coding sequence
MPPMLWLLLHFAAPALGFYFSISCPSGKQCQQALLSGNDILLYCNSSGAHWYYLFTQGKKGRLTSLTNISNMEIMPEGSLLIKDPLPSQTGLYHCWNKNGRQVVQYEIDFQDVTTLHITHKDLGQRPLQNETLHLGSKQLIFTWWEPWQDCNRCEEPGECKRLGYRYIEEPLEEAMPCWLYLGEVLVWSSRLRPELQVEACHVQCTNNTQLRVDYVIFDNFRLDEKTEFVWLDCPLGSMYRPVNWRANDTPLTWESQLSGQDFTTFLDPSTGGRQLQVFQPAVYKCFVQQELVAQFKPAASLETLEAQWRENDAQWREARKALRGRADSVLKGLKLVLLVVTVLALLGALLKCIHPSPGRRSTQVLVVK

SEQ ID NO: 10216 - protein, 539 aa, Artificial Sequence
  Description of Artificial Sequence: Synthetic coding sequence
MPPAGGPRAPRPAALPRSLSRLRECPGRSRIVLALGATQMALGCLIVAVSFAALALTTSARVRHSCPFWAGFSVLLSGLIGVVSWKRPLSLVITFFMLLSAVCVMLNLAGSILSCQNAQLVNSLEGCQLIKFDSVEVCVCCELQHQSSGCSNLGETLKLNPLQENCNAVRLTLKDLLFSVCALNVLSTIVCALATAMCCMQMVSSDVLQMFLPQRSHPANPTCVTPHGTVLHQTLDFDEFIPPLPPPPYYPPEYTCTPSTEAQRGLHLDFAPSPFGTLYDVAINSPGLLYPAELPPPYEAVVGQPPASQVTSIGQQVAESSSGDPNTSAGFSTPVPADSTSLLVSEGTATPGSSPSPDGPVGAPAPSEPALPPGHVSPEDPGMGSQVQPGPGRVSRSTSDPTLCTSSMAGDASSHRPSCSQDLEAGLSEAVPGSASMSRSATAACRAQLSPAGDPDTWKTDQRPTPEPFPATSKERPRSLVDSKAYADARVLVAKFLEHSHCALPTEAQHMVGAMRLAVTNEERLEEEAVFGADVLDQV

SEQ ID NO: 10217 - protein, 450 aa, Artificial Sequence
  Description of Artificial Sequence: Synthetic coding sequence
MILLVNLFVLLSVVCVLLNLAGFILGCQGAQFVSSVPRCDLVDLGEGKICFCCEEFQPAKCTDKENALKLFPVQPCSAVHLLLKKVLFALCALNALTTTVCLVAAALRYLQIFATRRSCIDESQISAEEAEDHGRIPDPDDFVPPVPPPSYFATFYSCTPRMNRRMVGPDVIPLPHIYGARIKGVEVFCPLDPPPPYEAVVSQMDQEQGSSFQMSEGSEAAVIPLDLGCTQVTQDGDIPNIPAEENASTSTPSSTLVRPIRSRRALPPLRTRSKSDPVLHPSEERAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 10218 - protein, 285 aa, Artificial Sequence [sequence omitted]

SEQ ID NO: 10219 - protein, 237 aa, Artificial Sequence
  Description of Artificial Sequence: Synthetic coding sequence
MTCFGPYPIGTGLQGITLCCFPSFCKMKSRMCMAISICQMLSMLSFVVCAFRYRHMFKRGWPMGTCCLFLPTAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 10220 - protein, 449 aa, Artificial Sequence
  Description of Artificial Sequence: Synthetic coding sequence
VLLVNLFVLLSVVCVLLNLAGFILGCQGAQFVSSVPRCDLVDLGEGKICFCCEEFQPAKCTDKENALKLFPVQPCSAVHLLLKKVLFALCALNALTTTVCLVAAALRYLQIFATRRSCIDESQISAEEAEDHGRIPDPDDFVPPVPPPSYFATFYSCTPRMNRRMVGPDVIPLPHIYGARIKGVEVFCPLDPPPPYEAVVSQMDQEQGSSFQMSEGSEAAVIPLDLGCTQVTQDGDIPNIPAEENASTSTPSSTLVRPIRSRRALPPLRTRSKSDPVLHPSEERAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 10221 - protein, 450 aa, Artificial Sequence; identical to SEQ ID NO: 10217
  Description of Artificial Sequence: Synthetic coding sequence

SEQ ID NO: 10222 - protein, 357 aa, Artificial Sequence
  Description of Artificial Sequence: Synthetic coding sequence
MGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSCGVSCLAAGWSVVPAPTASASTGAAGRLGSDLGFLSH

SEQ ID NO: 10223 - protein, 242 aa, Artificial Sequence
  Description of Artificial Sequence: Synthetic coding sequence
MMPSPSDSSRSLTSRPSTRGLTHLRLHRPWLQALLTLGLVQVLLGILVVTFSMVASSVTTTESIKRSCPSWAGFSNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGGKQILVPLRMRVALSDLQGHYGQGKGMAQVFKYRVTCAYAMGW

SEQ ID NO: 10224 - protein, 572 aa, Artificial Sequence
  Description of Artificial Sequence: Synthetic coding sequence
MMPSPSDSSRSLTSRPSTRGLTHLRLHRPWLQALLTLGLVQVLLGILVVTFSMVASSVTTTESIKRSCPSWAGFSNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 10225 - protein, 668 aa, Artificial Sequence
  Description of Artificial Sequence: Synthetic coding sequence
MMPSPSDSSRSLTSRPSTRGLTHLRLHRPWLQALLTLGLVQVLLGILVVTFSMVASSVTTTESIKRSCPSWAGFSLAFSGVVGIVSWKRPFTLVISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 10226 - protein, 650 aa, Artificial Sequence
  Description of Artificial Sequence: Synthetic coding sequence
MMPSPSDSSRSLTSRPSTRGLTHLRLHRPWLQALLTLGLVQVLLGILVVTFSMVASSVTTTESIKRSCPSWAGFSISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTQLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 10227 - protein, 144 aa, Artificial Sequence
  Description of Artificial Sequence: Synthetic coding sequence
MMPSPSDSSRSLTSRPSTRGLTHLRLHRPWLQALLTLGLVQVLLGILVVTFSMVASSVTTTESIKRSCPSWAGFSNLLFSVCGLTICAAIICTLSAIVCCIQIFSLDLVHTLTSGTFIPKCLRKKLLLFPLQIQGSALKPASSA

SEQ ID NO: 10228 - protein, 519 aa, Artificial Sequence
  Description of Artificial Sequence: Synthetic coding sequence
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 10229 - protein, 519 aa, Artificial Sequence; identical to SEQ ID NO: 10228
  Description of Artificial Sequence: Synthetic coding sequence

SEQ ID NO: 10230 - protein, 519 aa, Artificial Sequence; identical to SEQ ID NO: 10228
  Description of Artificial Sequence: Synthetic coding sequence

SEQ ID NO: 10231 - protein, 527 aa, Artificial Sequence
  Description of Artificial Sequence: Synthetic coding sequence
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQAAAAACLSMRLAFFIFPAWEDMRVPGKCCIGHARLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 10232 - protein, 331 aa, Artificial Sequence
  Description of Artificial Sequence: Synthetic coding sequence
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQGNRFTCFVICSCWGFWFIFFFPSLSFSK

SEQ ID NO: 10233 - protein, 535 aa, Artificial Sequence
  Description of Artificial Sequence: Synthetic coding sequence
MTPESRDTTDLSPGGTQEMEGIVIVKVEEEDEEDHFQKERNKVESSPQVLSRSTTMNERALLSSYLVAYRVAKEKMAHTAAEKIILPACMDMVRTIFDDKSADKLRTIPLSDNTISRRICTIAKHLEAMLITRLQSGIDFAIQLDESTDIASCPTLLVYVRYVWQDDFVEDLLCCLNLNSHITGLDLFTELENCLLGQYKLNWKHCKGISSDGTANMTGKHSRLTEKLLEATHNNAVWNHCFIHREALVSKEISPSLMDVLKNAVKTVNFIKGSSLNSRLLEIFCSEIGVNHTHLLFHTEVRWLSQGKVLSRVYELRNEIYIFLVEKQSHLANIFEDDIWVTKLAYLSDIFGILNELSLKMQGKNNDIFQYLEHILGFQKTLLLWQARLKSNRPSYYMFPTLLQHIEENIINEDCLKEIKLEILLHLTSLSQTFNYYFPEEKFESLKENIWMKDPFAFQNPESIIELNLEPEEENELLQLSSSFTLKNYYKILSLSAFWIKIKDDFPLLSRKSILLLLPFTTTYLCELGFSILTR

SEQ ID NO: 10234 - protein, 573 aa, Artificial Sequence
  Description of Artificial Sequence: Synthetic coding sequence
MTPESRDTTDLSPGGTQEMEGIVIVKVEEEDEEDHFQKERNKVESSPQVLSRSTTMNERALLSSYLVAYRVAKEKMAHTAAEKIILPACMDMVRTIFDDKSADKLRTIPLSDNTISRRICTIAKHLEAMLITRLQSGIDFAIQLDESTDIASCPTLLVYVRYVWQDDFVEDLLCCLNLNSHITGLDLFTELENCLLGQYKLNWKHCKGISSDGTANMTGKHSRLTEKLLEATHNNAVWNHCFIHREALVSKEISPSLMDVLKNAVKTVNFIKGSSLNSRLLEIFCSEIGVNHTHLLFHTEVRWLSQGKVLSRVYELRNEIYIFLVEKQSHLANIFEDDIWVTKLAYLSDIFGILNELSLKMQGKNNDIFQYLEHILGFQKTLLLWQARLKSNRPSYYMFPTLLQHIEENIINEDCLKEIKLEILLHLTSLSQTFNYYFPEEKFESLKENIWMKDPFAFQNPESIIELNLEPEEENELLQLSSSFTLKNYYKILSLSAFWIKIKDDFPLLSRKSILLLLPFTTTYLCELGFSILTRLKTKKRNRLNSAPDMRVALSSCVPDWKELMNRQAHPSH

SEQ ID NO: 10235 - protein, 1335 aa, Artificial Sequence
  Description of Artificial Sequence: Synthetic coding sequence
MLSPTFVLWEVGYPLYIYGSIFIVIVIIWQVKRSHHELSSEPKRSCCRCHQKVRQRARDAASTARRRSREEAEKPQKLLSIIKSQGWLPLERSVRRILCADPCCQICNSVALEIQQLLVGENNQISLTLSGPLQGSSCLEMLSTSSMSLDQSLEFHSWHTRELSLSSVTPTLSQLTDQKSLTQSAAQSTYADGIQDYWADHLQLGQEFQVPDVLRGPNTIASSRIEKPRAPLNQEEMTQSNPSLVQGNQGQHHLNSQVSLLSLNPETLNRMHPMALHMVLPAHLPFLSPEVLRLLEVHVKKWMHFQRWGLPRRVEESLRQLMPNPPLYYQPGNDQPVSFNLKNTPQVSLHRFETISLQTWCSCVAGQPIQTFWVSEWSTMNPEQRHHCQQTPNPMALALPSPALKALSGPHPQSGGQDNDSGSDLQQKYSQLFCGLPSLHSESLVATFMGSQGLPKIENVPKPPLKDPFLFNELSFPQLLPKTSPQSAPPSSPLSPNWMSPSDHQRAQINVPFLTLAEYEALEWHLLQRQLQLQWGWPAALQRSQHTQCLMQHEPCGKAQSPETTTASQTGKSISVLTRELLFFPEHARKLLEFHIQKQLIRHRWGLPQKIQQSIQLLLTSTDQQTVSSSSTALANVSIPQPVALEANGACDVLSPIAAPVSIPRPHLLTQVKAILQSHIDSKCGQIHQGKIPACVHRSWDCRISGVLAVAPFPCIPESQFLELQTASDPDLHHKVMPWMPTALDQQQQALPGTVTEHPKLLRVLSVEAIEKLETTLRHKHLAFLSGLPALYYVALPRALAPAVTSQSVITEMEPSPVEIPAEPLIQMVSFEEQCISLGPCPQGNNESCTDVAKEFQPAVPVKGTMETLPLESQTHPTSPHSLQTHILTKLNFHLRKKVLEIQWGIPIRARKSREQTVAAPENISTQKSLESLNHQGETLLQELPIPPDTLPAPNPEGVHLKEQLANDLKAVQQNQKQSNSKAVPQGSAHSVSKISQPSGDMTEAHMPCVQVEANVNKPSLEEPCGPEPQSPSKSKDPAHVPMLAGNREDPEETKAARDHREGDAGFGRSSTREERRPAEDQRPAGMLPNKTPRGSWRWSRSFHLADPCQHSPQHHPQLKLPQLPPRVPGEKESEKDLQDSQTKLTVILEPATIPENAQTVLPQASQGQPFLSQPTQAKPLQGQTLQGQVLHGLVMPVHAQKKPSLTESSFRNKIKCFLQHINPKTKGKGHEDSMFSAAAKVAKTRKENVAKSLAPAKSPVGRSKTEKPTGCSKAQSRPAQKLVGPAFLDGPQSLDDKLRLHSRQPGSASALGYPRHCPRHCPREACANKPGHPT

SEQ ID NO: 10236 - protein, 171 aa, Artificial Sequence
  Description of Artificial Sequence: Synthetic coding sequence
MWTLKSSLVLLLCLTCSYAFMFSSLRQKTSEPQGKVQYGEHFRIRQNLPEHTQGWLGSKWLWLLFVVVPFVILQCQRDSEKNKEQSPPGLRGGQLHSPLKKKRNASPNKDCAFNTLMELEVELMKFVSKVRNLKRAMATGSGSNLRLRKSEMPADPYHVTICEIWGEESSS

SEQ ID NO: 10237 - protein, 171 aa, Artificial Sequence
  Description of Artificial Sequence: Synthetic coding sequence
MWTLKSSLVLLLCLTCSYAFMFSSLRQKTSEPQGKVPCGEHFRIRQNLPEHTQGWLGSKWLWLLFAVVPFVILQCQRDSEKNKEQSPPGLRGFPFRTPLKKNQNASLYKDCVFNTLNELEVELLKFVSEVQNLKGAMATGSGSNLKLRRSEMPADPYHVTICKIWGEESSS

SEQ ID NO: 10238 - protein, 1341 aa, Artificial Sequence
  Description of Artificial Sequence: Synthetic coding sequence
MMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 10239 - protein, 1279 aa, Artificial Sequence
  Description of Artificial Sequence: Synthetic coding sequence
MMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 10240 - protein, 1320 aa, Artificial Sequence
  Description of Artificial Sequence: Synthetic coding sequence
MMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 10241 - protein, 1253 aa, Artificial Sequence
  Description of Artificial Sequence: Synthetic coding sequence
MPRLSGKSVRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 10242 - protein, 1067 aa, Artificial Sequence
  Description of Artificial Sequence: Synthetic coding sequence
MNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKFGKLWPPHCHILLIKFYWNT

SEQ ID NO: 10243 - protein, 156 aa, Artificial Sequence
  Description of Artificial Sequence: Synthetic coding sequence
SPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQVRNPL

SEQ ID NO: 10244 - protein, 1223 aa, Artificial Sequence
  Description of Artificial Sequence: Synthetic coding sequence
RVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFTPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTSVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSRGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNTFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 10245 - protein, 1253 aa, Artificial Sequence
  Description of Artificial Sequence: Synthetic coding sequence
MPRLSGKSVRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFTPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTSVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSRGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNTFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 10246 - protein, 275 aa, Artificial Sequence
  Description of Artificial Sequence: Synthetic coding sequence
EPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVE

SEQ ID NO: 10247 - protein, 922 aa, Artificial Sequence
  Description of Artificial Sequence: Synthetic coding sequence
MRKRMMMAVTFSLTLRRRRKILRTLKKILDLKEADLHRLQMSWLPASRGMPWVEWTRSRQPYPQEKQNLGRHSKRRRKGELLQTMKRITYSHPPLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTSVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSRGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKFGKLWPPHCHILLIKFYWNT

SEQ ID NO: 10248 - protein, 510 aa, Artificial Sequence
  Description of Artificial Sequence: Synthetic coding sequence
MEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNTFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 10249 - protein, 272 aa, Artificial Sequence
  Description of Artificial Sequence: Synthetic coding sequence
MQWNVPRTVSRLARRTCLEPHNAGLFGHCQNVKGPLLLYNAESKVVLVQGPQKQWLHLSAAQCVAKERRPLDAHPPQPGVLRHKQGKQHVSFRRVFSSSATAQGTPEKKEEPDPLQDKSISLYQRFKKTFRQYGKVLIPVHLITSGVWFGTFYYAALKGVNVVPFLELIGLPDSVVSILKNSQSGNALTAYALFKIATPARYTVTLGGTSVTVKYLRSHGYMSTPPPVKEYLQDRMEETKELITEKMEETKDRLTEKLQETKEKVSFKKKVE

SEQ ID NO: 10250 - protein, 272 aa, Artificial Sequence; identical to SEQ ID NO: 10249
  Description of Artificial Sequence: Synthetic coding sequence

SEQ ID NO: 10251 - protein, 192 aa, Artificial Sequence
  Description of Artificial Sequence: Synthetic coding sequence
MAGLLALLGPAGRVGARVRPRATWLLGATAPCAPPPLALALLPPRLDARLLRTARGDCRGHQDPSQATGTTGSSVSCTEEKKQSKSQQLKKIFQEYGTVGVSLHIGISLISLGIFYMVVSSGVDMPAILLKLGFKESLVQSKMAAGTSTFVVAYAIHKLFAPVRISITLVSVPLIVRYFRKVGFFKPPAAKP

SEQ ID NO: 10252 - protein, 314 aa, Artificial Sequence
  Description of Artificial Sequence: Synthetic coding sequence
MCPTLNNIVSSLQRNGIFINSLIAALTIGGQQLFSSSTFSCPCQVGKNFYYGSAFLVIPALILLVAGFALRSQMWTITGEYCCSCAPPYRRISPLECKLACLRFFSITGRAVIAPLTWLAVTLLTGTYYECAASEFASVDHYPMFDNVSASKREEILAGFPCCRSAPSDVILVRDEIALLHRYQSQMLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 10253 - protein, 128 aa, Artificial Sequence
  Description of Artificial Sequence: Synthetic coding sequence
MLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 10254 - protein, 171 aa, Artificial Sequence
  Description of Artificial Sequence: Synthetic coding sequence
MFDNVSASKREEILAGFPCCRSAPSDVILVRDEIALLHRYQSQMLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 10255 - protein, 170 aa, Artificial Sequence
  Description of Artificial Sequence: Synthetic coding sequence
MAPRSAKETFRINPNVAANLSAPSDVILVRDEIALLHRYQSQMLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 10256 - protein, 123 aa, Artificial Sequence
  Description of Artificial Sequence: Synthetic coding sequence
MLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRG

SEQ ID NO: 10257 - protein, 309 aa, Artificial Sequence
  Description of Artificial Sequence: Synthetic coding sequence
MDAFQGILKFFLNQKTVIGYSFMALLTVGSERLFSVVAFKCPCSTENMTYGLVFLFAPAWVLLILGFFLNNRSWRLFTGCCVNPRKIFPRGHSCRFFYVLGQITLSSLVAPVMWLSVALLNGTFYECAMSGTRSSGLLELICKGKPKECWEELHKVSCGKTSMLPTVNEELKLSLQAQSQILGWCLICSASFFSLLTTCYARCRSKVSYLQLSFWKTYAQKEKEQLENTFLDYANKLSERNLKCFFENKRPDPFPMPTFAAWEAASELHSFHQSQQHYSTLHRVVDNGLQLSPEDDETTMVLVGTAHNM

SEQ ID NO: 10258 - protein, 315 aa, Artificial Sequence
  Description of Artificial Sequence: Synthetic coding sequence
MEKFRAVLDLHVKHHSALGYGLVTLLTAGGERIFSAVAFQCPCSAAWNLPYGLVFLLVPALALFLLGYVLSARTWRLLTGCCSSARASCGSALRGSLVCTQISAAAALAPLTWVAVALLGGAFYECAATGSAAFAQRLCLGRNRSCAAELPLVPCNQAKASDVQDLLKDLKAQSQVLGWILIAVVIIILLIFTSVTRCLSPVSFLQLKFWKIYLEQEQQILKSKATEHATELAKENIKCFFEGSHPKEYNTPSMKEWQQISSLYTFNPKGQYYSMLHKYVNRKEKTHSIRSTEGDTVIPVLGFVDSSGINSTPEL

SEQ ID NO: 10259 - protein, 67 aa, Artificial Sequence
  Description of Artificial Sequence: Synthetic coding sequence
MRKPQAGTGEAARDPSLRPARTVLVGDQDEYTAAENKSPRGTLCPTGEQRIHAREDACIFSRLFSEK

SEQ ID NO: 10260 - protein, 130 aa, Artificial Sequence
  Description of Artificial Sequence: Synthetic coding sequence
MAAPPEPGEPEERKASCTSLHLSYWKSLKLLGFLDVENTPCARHSILYGSLGSVVAGFGHFLFTSRIRRSCDVGVGGFILVTLGCWFHCRYNYAKQRIQERIAREEIKKKILYEGTHLDPERKHNGSSSN

SEQ ID NO: 10261 - protein, 118 aa, Artificial Sequence
  Description of Artificial Sequence: Synthetic coding sequence
MAAPPEPGEPEERKSLKLLGFLDVENTPCARHSILYGSLGSVVAGFGHFLFTSRIRRSCDVGVGGFILVTLGCWFHCRYNYAKQRIQERIAREEIKKKILYEGTHLDPERKHNGSSSN

SEQ ID NO: 10262 - protein, 559 aa, Artificial Sequence
  Description of Artificial Sequence: Synthetic coding sequence
MVEKILIHRILTLFPNAIARKLLLMLTFILIFWIIYLASKDHTKFSFNLENHIILNQGNIFKKYSHSETPLCPAVSPKETELRIKDIMEKLDQQIPPRPFTHVNTTTSATHSTATILNPQDTYCRGDQLDILLEVRDHLGHRKQYGGDFLRARMYSTALMAGASGKVTDFNNGTYLVSFTLFWEGQVSLSLLLIHPSEGVSALWRARNQGCDRIIFTGLFANRSSNVFTECGLTLNTNAELCQYMDDRDQEAFYCVRPQHMPCEALTHMTTRTRNISYLSKEEWRLFHRSNIGVEMMKNFTPIEVIPCNKSENIKKNCQIGMKTPFPSGYTLKKMWITAFCKQIKFNETKNINDCLERKLIYLMGDSTLHQWIYYLQKAVKTLKYFDHHGAGIFKTHVLLDVERHILIQWKKHGHPFVTKKLFSVKDENYIPREIDQVAGDKNTAIVITLGQHFRPFPINIFIRRAINIQKAIERLFLRSPETKVILKTENTREIEQNAEMFSDFHGYIQNLIIRDIFVDLNVGIIDAWDMTIAYCTNNAHPPDYVIQNQIGMFLNYIC

SEQ ID NO: 10263 - protein, 365 aa, Artificial Sequence
  Description of Artificial Sequence: Synthetic coding sequence
MVEKILIHRILTLFPNAIARKLLLMLTFILIFWIIYLASKDHTKFSFNLENHIILNQGNIFKKYSHSETPLCPAVSPKETELRIKDIMEKLDQQIPPRPFTHVNTTTSATHSTATILNPQDTYCRGDQLDILLEVRDHLGHRKQYGGDFLRARMYSTALMAGASGKVTDFNNGTYLVSFTLFWEGQVSLSLLLIHPSEGVSALWRARNQGCDRIIFTGLFANRSSNVFTECGLTLNTNAELCQYMDDRDQEAFYCVRPQHMPCEALTHMTTRTRNISYLSKEEWRLFHRSNIGVEMMKNFTPIEVIPCPALFYFIFRDSLTLSPRLECSGMISAHCNLCLPGSSDSPDSASHVAGITSVQRHTWL

SEQ ID NO: 10264 - protein, 241 aa, Artificial Sequence
  Description of Artificial Sequence: Synthetic coding sequence
  MOD_RES (1)..(1): Any amino acid
XQTARCHSGLVSSVQAIMASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQYKQQHTLLHKVNGALMLLSFLCCRVLLFPYLYWAYGRHAGLPLLAVPLAIPAHVNLGAALLLAPQLYWFFLICRGACRLFWPRSRPPPACQAQD

SEQ ID NO: 10265 - protein, 274 aa, Artificial Sequence
  Description of Artificial Sequence: Synthetic coding sequence
MLTPMVAGGVVFPGLFLLSKNTLQRLPQLRWEEADAVIVSARLVSSVQAIMASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQYKQQHTLLHKVNGALMLLSFLCCRVLLFPYLYWAYGRHAGLPLLAVPLAIPAHVNLGAALLLAPQLYWFFLICRGACRLFWPRSRPPPACQAQD

SEQ ID NO: 10266 - protein, 428 aa, Artificial Sequence
  Description of Artificial Sequence: Synthetic coding sequence
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 10267 - protein, 162 aa, Artificial Sequence
  Description of Artificial Sequence: Synthetic coding sequence
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKDRHR

SEQ ID NO: 10268 - protein, 344 aa, Artificial Sequence
  Description of Artificial Sequence: Synthetic coding sequence
MVEWRTCLSVAPGQQVYSGLWRDKDVTIKCGIEETLDSKARSDAAPRRELVLFDKPTRGTSIKEFREMTLSFLKANLGDLPSLPALVGQVLLMADFNKDNRVSLAEAKSVWALLQRNEFLLLLSLQEKEHASRLLGYCGDLYLTEGVPHGAWHAAALPPLLRPLLPPALQGALQQWLGPAWPWRAKIAIGLLEFVEELFHGSYGTFYMCETTLANVGYTATYDFKMADLQQVAPEATVRRFLQGRRCEHSTDCTYGRDCRAPCDRLMRQCKGDLIQPNLAKVCALLRGYLLPGAPADLREELGTQLRTCTTLSGLASQVEAHHSLVLSHLKTLLWKKISNTKYS

SEQ ID NO: 10269 - protein, 431 aa, Artificial Sequence
  Description of Artificial Sequence: Synthetic coding sequence
MRRLRRLAHLVLFCPFSKRLQGRLPGLRVRCIFLAWLGVFAGSWLVYVHYSSYSERCRGHVCQVVICDQYRKGIISGSVCQDLCELHMVEWRTCLSVAPGQQVYSGLWRDKDVTIKCGIEETLDSKARSDAAPRRELVLFDKPTRGTSIKEFREMTLSFLKANLGDLPSLPALVGQVLLMADFNKDNRVSLAEAKSVWALLQRNEFLLLLSLQEKEHASRLLGYCGDLYLTEGVPHGAWHAAALPPLLRPLLPPALQGALQQWLGPAWPWRAKIAIGLLEFVEELFHGSYGTFYMCETTLANVGYTATYDFKMADLQQVAPEATVRRFLQGRRCEHSTDCTYGRDCRAPCDRLMRQCKGDLIQPNLAKVCALLRGYLLPGAPADLREELGTQLRTCTTLSGLASQVEAHHSLVLSHLKTLLWKKISNTKYS

SEQ ID NO: 10270 - protein, 419 aa, Artificial Sequence
  Description of Artificial Sequence: Synthetic coding sequence
MARAAGARGPAGWCRRRGRCGRGTLLAFAAWTAGWVLAAALLLRAHPGVLSERCTDEKSRRILAALCQDYQGGTLAGDLCEDLCVAGELLFQRCLHYNRGKKVLQADWRGRPVVLKSKEEAFSSFPPLSLLEEEAGEGGQDMPEAELLLMVAGEVKSALGLELSNSSLGPWWPGRRGPRWRGQLASLWALLQQEEYVYFSLLQDLSPHVLPVLGSCGHFYAVEFLAAGSPHHRALFPLDRAPGAPGGGQAKAISDIALSFLDMVNHFDSDFSHRLHLCDIKPENFAIRSDFTVVAIDVDMAFFEPKMREILEQNCTGDEDCNFFDCFSRCDLRVNKCGAQRVNNNLQVICDKIFRHWFSAPLKSSAVSFQLQLQLQEAVQECADPGVPSGNTRRAASSVFWKLRQLLQATLRELQEAEK

SEQ ID NO: 10271 - protein, 349 aa, Artificial Sequence
  Description of Artificial Sequence: Synthetic coding sequence
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEEVISSSTKNSPSTRVMRNLTQAAREVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 10272 - protein, 185 aa, Artificial Sequence
  Description of Artificial Sequence: Synthetic coding sequence
MVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 10273 - protein, 325 aa, Artificial Sequence
  Description of Artificial Sequence: Synthetic coding sequence
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEEVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 10274 - protein, 241 aa, Artificial Sequence
  Description of Artificial Sequence: Synthetic coding sequence
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEENPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 10275 - protein, 326 aa, Artificial Sequence
  Description of Artificial Sequence: Synthetic coding sequence
MQPPVPGPLGLLDPAEGLSRRKKTSLWFVGSLLLVSVLIVTVGLAATTRTENVTVGGYYPGIILGFGSFLGIIGINLVENRRQMLVAAIVFISFGVVAAFCCAIVDGVFAAQHIEPRPLTTGRCQFYSSGVGYLYDVYQTEVTCHSLDGKCQLKVRSNTCYCCDLYACGSAEPSPAYYEFIGVSGCQDVLHLYRLLWASAVLNVLGLFLGIITAAVLGAFKDMVPLSQLAYGPAVPPQTLYNPAQQILAYAGFRLTPEPVPTCSSYPLPLQPCSRFPVAPSSALASSEDLQPPSPSSSGSGLPGQAPPCYAPTYFPPGEKPPPYAP

SEQ ID NO: 10276 - protein, 632 aa, Artificial Sequence
  Description of Artificial Sequence: Synthetic coding sequence
MSDCCSAPGISWEAGVGRPAVPGLELQIRRGAMSEETVSESQFSLKTAALRVFDLPLTWYYSLSQIKFSPVAKKLFVVTAVSAISVIFLAHHFKRKRGKKKGKILPWEPEHLILEYTKRAASDKGSSCSSSRQNLTLSLSSTKDKGSQVCNYANGGLFSKYSGSAQSLASVQSVNSCHSCACGNSNSWDKADEDDIKLVNIPVTTPENLYLMGMELFEEALRRWEQALTFRNRQAEDEACGSIKLGAGDAIAEENVDDIISTEFIHKLEALLQRAYRLQEEFEATLGASDPNSLADDIDKDTDITMKGNVEDFGLRDTLSIASTDSFASAAELAEHREVRHTYSLESLCHCPFYEEAMHLVEEGKIYSRVLRTEMLECLGDSDFLAKLHCIRQAFQVILSESANRIFLAESGRKILSALIVKARKNPKKFEDVFDEMIYFLEQTDHWGSTEMELAARGVKNLNFYDVVLDFILMDSFEDLENPPTSIQNVVNNRWLNSSFKETAVASSCWSVLKQKRQQMKIPDGFFAHFYAICEHISPVLAWGFLGPRNSLYDLCCFFKNQVLLFLKDIFDFEKVRYSSTETLAEDLMQLLIRRTELLMAYLEADALRHTSSCLSSHGHVMSTGLLEAKVQ

SEQ ID NO: 10277 - protein, 595 aa, Artificial Sequence
  Description of Artificial Sequence: Synthetic coding sequence
MSDCCSAPGISWEAGVGRPAVPGLELQIKFSPVAKKLFVVTAVSAISVIFLAHHFKRKRGKKKGKILPWEPEHLILEYTKRAASDKGSSCSSSRQNLTLSLSSTKDKGSQVCNYANGGLFSKYSGSAQSLASVQSVNSCHSCACGNSNSWDKADEDDIKLVNIPVTTPENLYLMGMELFEEALRRWEQALTFRNRQAEDEACGSIKLGAGDAIAEENVDDIISTEFIHKLEALLQRAYRLQEEFEATLGASDPNSLADDIDKDTDITMKGNVEDFGLRDTLSIASTDSFASAAELAEHREVRHTYSLESLCHCPFYEEAMHLVEEGKIYSRVLRTEMLECLGDSDFLAKLHCIRQAFQVILSESANRIFLAESGRKILSALIVKARKNPKKFEDVFDEMIYFLEQTDHWGSTEMELAARGVKNLNFYDVVLDFILMDSFEDLENPPTSIQNVVNNRWLNSSFKETAVASSCWSVLKQKRQQMKQIPDGFFAHFYAICEHISPVLAWGFLGPRNSLYDLCCFFKNQVLLFLKDIFDFEKVRYSSTETLAEDLMQLLIRRTELLMAYLEADALRHTSSCLSSHGHVMSTGLLEAKVQ

SEQ ID NO: 10278 - protein, 323 aa, Artificial Sequence
  Description of Artificial Sequence: Synthetic coding sequence
MAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSETESHSVARLECSGAISAQCNLRFLGSRDSPASASQVAGITARVTAEGVCREAGVPAAPCLPPAGGVRLHLPRRQHAARPREDPHAAPDRGLAAAAGGR

SEQ ID NO: 10279 - protein, 593 aa, Artificial Sequence
  Description of Artificial Sequence: Synthetic coding sequence
MAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSEPESQRKEFAEKLESLLHRAYHLQEEFGSTFPADSMLLDLERTLMLPLTEGSLRLRADDEDSLTSEDSFFSATELFESLQTGDYPIPLSRPAAAYEEALQLVKEGRVPCRTLRTELLGCYSDQDFLAKLHCVRQAFEGLLEDKSNQLFFGKVGRQMVTGLMTKAEKSPKGFLESYEEMLSYALRPETWATTRLELEGRGVVCMSFFDIVLDFILMDAFEDLENPPASVLAVLRNRWLSDSFKETALATACWSVLKAKRRLLMVPDGFISHFYSVSEHVSPVLAFGFLGPKPQLAEVCAFFKHQIVQYLRDMFDLDNVRYTSLPALADDILQLSRRRSEILLGYLGVPAASSAGVNGALPRENGPLGELQ

SEQ ID NO: 10280 - protein, 349 aa, Artificial Sequence
  Description of Artificial Sequence: Synthetic coding sequence
MAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSEPESQRKEFAEKLESLLHRAYHLQEEFGSTFPADSMLLDLERTLMLPLTEGSLRLRADDEDSLTSEDSFFSATELFESLQTGDYPIPLSRPAAAYEEALQLVKEGRVPCRTLRAPKASWRATRRC

SEQ ID NO: 10281 - protein, 100 aa, Artificial Sequence
  Description of Artificial Sequence: Synthetic coding sequence
MAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSV

SEQ ID NO: 10282 - protein, 127 aa, Artificial Sequence
  Description of Artificial Sequence: Synthetic coding sequence
MWRELRGCPGGDVETAQRLSQRRRGKSSEAVPEKTWRAQRMSQRRRGESSEAVPEKTWKELRNSETVPEKTWKQLRRCLQEDVERVQRLSLLLHLAVFLWIIIAINFSNSGVKSQSSTYLPSGKILK

SEQ ID NO: 10283 - protein, 127 aa, Artificial Sequence; identical to SEQ ID NO: 10282
  Description of Artificial Sequence: Synthetic coding sequence

SEQ ID NO: 10284 - protein, 1347 aa, Artificial Sequence
  Description of Artificial Sequence: Synthetic coding sequence
MENLPFPLKLLSASSLNAPSSTPWVLDIFLTLVFALGFFFLLLPYLSYFRCDDPPSPSPGKRKCPVGRRRRPRGRMKNHSLRAGRECPRGLQETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSPPPPKGFTAPPLRDSTLITPSHCDSVALPLGTVPQSLSPHEDLVASVPAISGLGGSNSHVSASSRWQETARTSCAFNSSVQQDHLSRHPPETYQMEAGSLFLLSSDGQNAVGIQVTETAKVNIWEEKENVGSFTDRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPPSHLGPECQPFISSTPQFRPTPMAQAEAQAHLQSSFPVLSPAFPSLIKNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGESSKEAQKVKFQLERDPCPHLGQILGETPQNLSRDMKSFPRKVLGVTSEESERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHGPLKPPPAGQEGRWPSKPLTYSLTGSTQQSRSLGAQSSKAGETREAVPQCRVPLETCMLANLQATSEDMHGFEAPGTSKSSLHPRVSVSQDPRKLCLMEEVVNEFEPGMATKSETQPQVCAAVVLLPDGQASVVPHASENLVSQVPQGHLQSMPAGNMRASQELHDLMAARRSKLVHEEPRNPNCQGSCKNQRPMFPPIHKSEKSRKPNLEKHEERLEGLRTPQLTPVRKTEDTHQDEGVQLLPSKKQPPSVSHFGGNIKQFFQWIFSKKKSKPAPVTAESQKTVKNRSCVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPLQHWPKTSGASSHHHHCPRHCLLWEGI

SEQ ID NO: 10285 - protein, 1347 aa, Artificial Sequence
  Description of Artificial Sequence: Synthetic coding sequence
MENLPFPLKLLSASSLNAPSSTPWVLDIFLTLVFALGFFFLLLPYLSYFRCDDPPSPSPGKRKCPVGRRRRPRGRMKNHSLRAGRECRRGLQETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSPPPPKGFTAPPLRDSTLITPSHCDSVALPLGTVPQSLSPHEDLVASVPAISGLGGSNSHVSASSRWQETARTSCAFNSSVQQDHLSRHPPETYQMEAGSLFLLSSDGQNAVGIQVTETAKVNIWEEKENVGSFTDRMTPEKHLNSLRNLAKSLDAEQDTTNPKPFWNMGENSKQLPGPQKFSDPRLWQESFWKNYSQLFWGLPSLHSESLVANAWVTDRSYTLQSPPFLFNEMSNVCPIQRETTMSPLLFQAQPPSHLGPECQPFISSTPQFRPTPMAQAEAQAHLQSSFPVLSPAFPSLIKNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGESSKEAQKVKFQLERDPCPHLGQILGETPQNLSRDMKSFPRKVLGVTSEESERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHGPLKPPPAGQEGRWPSKPLTYSLTGSTQQSRSLGAQSSKAGETREAVPQCRVPLETCMLANLQATSEDMHGFEAPGTSKSSLHPRVSVSQDPRKLCLMEEVVNEFEPGMATKSETQPQVCAAVVLLPDGQASVVPHASENLVSQVPQGHLQSMPTGNMRASQELHDLMAARRSKLVHEEPRNPNCQGSCKSQRPMFPPIHKSEKSRKPNLEKHEERLEGLRTPQLTPVRKTEDTHQDEGVQLLPSKKQPPSVSHFGGNIKQFFQWIFSKKKSKPAPVTAESQKTVKNRSCVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPLQHWPKTSGASSHHHHCPRHCLLWEGI

SEQ ID NO: 10286 - protein, 1347 aa, Artificial Sequence
  Description of Artificial Sequence: Synthetic coding sequence
MENLPFPLKLLSASSLNAPSSTPWVLDIFLTLVFALGFFFLLLPYLSYFRCDDPPSPSPGKRKCPVGRRRRPRGRMKNHSLRAGRECRRGLEETSDLLSQLQSLLGPHLDKGDFGQLSGPDPPGEVGERAPDGASQSSHEPMEDAAPILSLLASPDPQAKHPQDLASTPSPGPMTTSVSSLSASQPPEPSLPLEHPSPEPPALFPHPPHTPDPLACSLPPPKGFTAPPLRDSTLITPSHCDSVALPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLQDESPGTSQAKGKPSPWQSSMSTGESSKEAQKVKFQLERDPCPHLGQILGETPQNLSRDMKSFPRKVLGVTSEELERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSTQQSRSLGAQSSKAGETREAVPQCRVPLETCMLANLQATSEDVHGFEAPGTSKSSLHPRVSVSQDPRKLCLMEEVVSEFEPGMATKSETQPQVCAAVVLLPDGQASVVPHASENLVSQVPQGHLQSMPTGNMRASQELHDLMAARRSKLVHEEPRKPNCQGSCKSQRPMFPPIHKSEKFRKPNLEKHEERLEGLRTPQLTPVRKTEDTHQDEGVQLLPSKKQPPSVSPFGENIKQIFQWIFSKKKSKPAPVTAESQKTVKNRSCVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 10287 - protein, 1357 aa, Artificial Sequence
  Description of Artificial Sequence: Synthetic coding sequence
  MOD_RES (1)..(1): Any amino acid
XLLESNAPIHMENLPFPLKLLSASSLNAPSSTPWVLDIFLTLVFALGFFFVLLPYLSYFRCDDPPSPSPGKRKCPVGRRRRPRGRMKNHSLRAGRECRRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSLPPPKGFTAPPLRDSTLITPSHCDSVAFPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGESSKEAQKVKFQLERDPCPHLGQILGETPQNLSRDMKSFPRKVLGVTSEELERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSIQQSRSLGAQSSKAGETREAVPQCRVPLETCMLANLQATSEDVHGFEAPGTSKSSLHPRVSVSQDPRKLCLMEEVVNEFEPGMATKSETQPQVCAAVVLLPDGQASVVPHASENLVSQVPQGHLQSMPTGNMRASQELHDLMAARRSKLVHEEPRNPNCQGSCKSQRPMFPPIHKSEKSRKPNLEKHEERLEGLRTPQLTPVRKTEDTHQDEGVQLLPSKKQPPSVSPFGENIKQIFQWIFSKKKSKPAPVTAESQKTVKNRSRVYSSSAEAQGLMTAVGQMLDKKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 10288 - protein, 1347 aa, Artificial Sequence
  Description of Artificial Sequence: Synthetic coding sequence
MENLPFPLKLLSASSLNAPSSTPWVLDIFLTLVFALGFFFVLLPYLSYFRCDDPPSPSPGKRKCPVGRRRRPRGRMKNHSLRAGRECRRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSLPPPKGFTAPPLRDSTLITPSHCDSVAFPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGESSKEAQKVKFQLERDPCPHLGQILGETPQNLSRDMKSFPRKVLGVTSEELERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSIQQSRSLGAQSSKAGETREAVPQCRVPLETCMLANLQATSEDVHGFEAPGTSKSSLHPRVSVSQDPRKLCLMEEVVNEFEPGMATKSETQPQVCAAVVLLPDGQASVVPHASENLVSQVPQGHLQSMPTGNMRASQELHDLMAARRSKLVHEEPRNPNCQGSCKSQRPMFPPIHKSEKSRKPNLEKHEERLEGLRTPQLTPVRKTEDTHQDEGVQLLPSKKQPPSVSPFGENIKQIFQWIFSKKKSKPAPVTAESQKTVKNRSRVYSSSAEAQGLMTAVGQMLDKKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 10289 - protein, 1347 aa, Artificial Sequence
  Description of Artificial Sequence: Synthetic coding sequence
MENLPFPLKLLSASSLNAPSSTPWVLDIFLTLVFALGFFFLLLPYLSYFRCDDPPSPSPGKRKCPVGRRRRPRGRMKNHSLRAGRECRRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSLPPPKGFTAPPLRDSTLITPSHCDSVAFPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGEGSKEAQKVKFQLERDPCPHLGQILGETPQNLSRDMKSFPRKVLGVTSEELERNLRKPLRSDSGSDLLRCTERTHIENILKAHMGRNLGQTNEGLIPVCVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSIQQSRSLGAQSSKAGETREAVPQCRVPLETCMLANLQATSEDVHGFEAPGTSKSSLHPRVSVSQDPRKLCLMEEVVNEFEPGMATKSETQPQVCAAVVLLPDGQASVVPHASENLVSQVPQGHLQSMPTGNMRASQELHDLMAARRSKLVHEEPRNPNCQGSCKSQRPMFPPIHKSEKSRKPNLEKHEERLEGLRTPQLTPVRKTEDTHQDEGVQLLPSKKQPPSVSPFGENIKQIFQWIFSKKKSKPAPVTAESQKTVKNRSRVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 10290 - protein, 1343 aa, Artificial Sequence
  Description of Artificial Sequence: Synthetic coding sequence
MENLPFPLKLLSASSLNAPSSTPWVLDIFLTLVFALGFFFLLLPYLSYFHCDDPPSPSPGKRKCPVGRRRRPRGRMKNHSLRAGRECPRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSPPPPKGFTAPPLRDSTLITPSHCDSVALPLGTVPQSLSPHEDLVASVPAISGLGGSNSHVSASSRWQETARTSCAFNSSVQQDPLSRHPPETCQMEAGSLFLLSSDGQNVVGIQVTETAKVNIWEEKENVGSFTNQMTPEKHLNSLGNLAKSLDAEQDTTNPKPFWNMGENSKQLPGPQKCSDPRLLQESFWKNYSQLFWGLPSLHSESLVANAWVTDRSYTLQSPPFLFNEMSNVCPIQRETTMSPLLFQAQPLSHRQPFISSTPQFLPTPMAQAEAQAHLQSSFPVLSPAFPSLIKNTGVACPASQNKVQALSLPETQHPEWPLLRKQLEGRLALPSRVQKSQDVFSVSTPNLPQESLTSILPENFPVSPELRRQLEQHIKKWIIQHWGNLGRIQESLDLMQLRDESPGTSQAKGKPSPWQSSTSTGESSKEAQKVKFQLERDLCPHLGQILGETPQNLSRDMKSFPRKVLGVTSEESERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHGPLKPPPAGQEGRWPSKPLTYSLTGSTQQSRSLGAQSSKAGETREAVPQCRVPLETCMLANLQATSEDVHGFEAPGTSKSSLHPRVSVSQDPRKLCLMEEVVSEFEPGMATKSETQPQVCAAVVLLPDGQASVVPHASENLVSQVPQGHLQSMPTGNMRASQELHDLMAARRSKLVQEEPRNPNCQGSCKSQRPMFPPIHKSEKSRKPNLEKHEERLEGLRTPQLTPVRKTEDTHQDEGVQLLPSKKQPPSVSHFGENIKQFFQWIFSKKKSKPAPVTAESQKTVKNRSCVYSSSAEAQGLMTAVGQMLDKKMSLCHAHHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 10291 - protein, 1347 aa, Artificial Sequence
  Description of Artificial Sequence: Synthetic coding sequence
MENLPFPLKLLSASSLNAPSSTPWVLDIFLTLVFALGFFFLLLPYLSYFRCDDPPSPSPGKRKCPVGRRRRPRGRMKNHSLRAGRECPRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSLPPPKGFTAPPLRDSTLITPSHCDSVAFPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNYLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGESSKEAQKVKFQLERDPCPHLGQILGETPQNLSRDMKSFPRKVLGVTSEELERNLRKPLRSDSGSDLLRCTERTHIENILKAHMGRNLGQTNEGLIPVCVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSIQQSRSLGAQSSKAGETREAVPQCRVPLETCMLANLQATSEDVHGFEAPGTSKSSLHPRVSVSQDPRKLCLMEEVVNEFEPGMATKSETQPQVCAAVVLLPDGQASVVPHASENLVSQVPQGHLQSMPTGNMRASQELHDLMAARRSKLVHEEPRNPNCQGSCKSQRPMFPPIHKSEKSRKPNLEKHEERLEGLRTPQLTPVRKTEDTHQDEGVQLLPSKKQPPSVSPFGENIKQIFQWIFSKKKSKPAPVTAESQKTVKNRSRVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 10292 - protein, 1576 aa, Artificial Sequence
  Description of Artificial Sequence: Synthetic coding sequence
MENILCFLNSYTETGLSPDSHWLDIDPNFICLSGLGLFILYLFYVVLTLYSSPTEKNNDIQKHQGRAKRRRKGGTFKGFPDWKSFQREEEEERKLLSLLKSFGPPVSCSPRGQHHDTNHFRRLLCPDPVCRVCKRATADIQQLLSWESLKDAAPSVSPLASSASATESSFTLASTPSATPPEDLILSPRPKASPPPPLILSPDLITTLADLFSPSPLRDPLPPQPVSPLDSKFPIDHSPPQQLPFPLLPPHHIERVESSLQPEASLSLNTIFSFGSTLCQDISQAMNPIDSCARHHGPPIPSALPPEDCTVTQSKSSLTILKTFPEMLSLGGSGGSSTSAPTIKGIDHSHLASSEFTWWQPHAKDSFSSNFVPSDFMEELLTLHSSEAFLGGHSVANLIEPVNISFLSHDILALLERQVKKRGDFLMWKENGKKPGSFPKQLRPNYQLNSSRNMLTSIAVKHDLAESFPFWASKGKLEWQHIHQQPPHSKCFEDHLEQKYVQLFWGLPSLHSESLHPTVLVQRGHSSMFVFFNGITNTSISHESPVLPPPQPLSLPSTQPLPLPQTLPQGQSPHLTQVKSLAQPQSPFRALLPSPLFLIRICGVCFHRPQNEARSLLPSEINHLEWNVLQKVQESLWGLPSVVQKSQEDFCPPAPNPELVRKSFKVHVPISIIPGDFPLSSEVRKKLEQHIRRRLIQRRWGLPRRIHESLSLLRPQSKISELSVSERIHGPLNISLVEGQRCNVLKKSASSFPRSFHERSSNMLSMENVGNYQGYSQETVPKDHLLHGPETSSDKDLRSNSERDLETHMMHLSGNDSGVRLGQKQLENALTVRLSKKFEEINEGRMPGTVHSSWHSVKQTMSLPEKSHSQIKHRNLVTLVSEDHCVDTSQEISFLSSNKQKMLEAHIKTFRMRMLWGLPLKVLESIEIFKSKADLSTSFSHFDLPSSATFISQGDSKDGVSKSRSRSTFQGEKLGTTSSVPILDRPHPVSSPVVQEGQGTLRRQFSDTDHDLIETDSKDGASTSLRRGTTDFQSEKLDSTSSFPILGHSYLVTSPVNQEKQGTLRREFSDTDNDLTESVRTTEDGRQTFLPPPHSIVDEVSQKQTVLASRCSAELPIMQAGAGCESWDKRKSSFHNVDRLQGSRKTFPVTNALQSQTRNNLTTSKSGSCSLTNVKASTSNETEIFPPRISVPQDPKSSYLKNQMLSQLKLVQRKHSQPQSHFTDMSFALDNLSSKDLLTNSQGISSGDMGTSQVVHVHLEDSGIRVAQKQEPRVPTCVLQKCQVTNFPPAVNRVSPVRPKGGELDGGDAGLGTSQRRRKSLPVHNKTSGEVLGSKSSPTLKTQPPPENLFRKWMKTSLQWFNKPSISYEEQESSWEKGSSLSSCVQNIGRVIRAAFTGTTEAQKIRKDTREFLEEKLGHRHGIDITCPQEPLSFPVGLGKAQHNPEVHVRAEPVQGCPCNYRAPSCKVTRTKSCSQQAIFVGQNYPTRIRQIIDKDRQPQKVEAFKGKILCQSHPQSMPHRKPVPHPNPTCRRQVSLVCPAVPTSAKSPVFSDVPFLTGQKMLPKHLQGGKFPPTK

SEQ ID NO: 10293 - protein, 413 aa, Artificial Sequence
  Description of Artificial Sequence: Synthetic coding sequence
MAEGPEEARGHPPGQDDGGGDHEPVPSLRGPPTTAVPCPRDDPQAEPQAPGRPTAPGLAAAAAADKLEPPRELRKRGEAASGSGAELQEQAGCEAPEAAAPRERPARLSAREYSRQVHEWLWQSYCGYLTWHSGLAAFPAYCSPQPSPQSFPSGGAAVPQAAAPPPPQLGYYNPFYFLSPGAAGPDPRTAAGISTPAPVAGLGPRAPHVQASVRATPVTRVGSAAPSRSPSETGRQAGREYVIPSLAHRFMAEMVDFFILFFIKATIVLSIMHLSGIKDISKFAMHYIIEEIDEDTSMEDLQKMMVVALIYRLLVCFYEIICIWGAGGATPGKFLLGLRVVTCDTSVLIAPSRVLVIPSSNVSITTSTIRALIKNFSIASFFPAFITLLFFQHNRTAYDIVAGTIVVKRNGVR

SEQ ID NO: 10294 - protein, 163 aa, Artificial Sequence
  Description of Artificial Sequence: Synthetic coding sequence
MAEMVDFFILFFIKATIVLSIMHLSGIKDISKFAMHYIIEEIDEDTSMEDLQKMMVVALIYRLLVCFYEIICIWGAGGATPGKFLLGLRVVTCDTSVLIAPSRVLVIPSSNVSITTSTIRALIKNFSIASFFPAFITLLFFQHNRTAYDIVAGTIVVKRNGVR

SEQ ID NO: 10295 - protein, 304 aa, Artificial Sequence
  Description of Artificial Sequence: Synthetic coding sequence
MNIVFSRDSQVRVMENTVANTEKYFGQFCSLLAAYTRKTARLRDKADQLVKQLIDFANSENPELRATMRGFAEDLAKVQDYRQAQVERLETKVVNPLKLYGAQIKQTRAEIKKFKHVQNHEIKQLEKLEKLRQKSPSDQQMIGQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQGTLQVQLSRANEDPEHPHANHGRFSLCEWVVKGQPAHCVCGQGGHLMLPGHSL

SEQ ID NO: 10296 - protein, 304 aa, Artificial Sequence
  Description of Artificial Sequence: Synthetic coding sequence
MNIVFSRDSQVRVMENTVANTEKYFGQFCSLLAAYTRKTARLRDKADQLVKQLIDFANSENPELRATMRGFAEDLAKVQDYRQAQVERLETKVVNPLKLYGAQIKQTRAEIKKFKHVQNHEIKQLEKLEKLRQKSPSDQQMISQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQGTLQVQLSRANEDPEHPHANHGRFSLCEWVVKGQPAHCVCGQGGHLMLPGHSL

SEQ ID NO: 10297 - protein, 1133 aa, Artificial Sequence
  Description of Artificial Sequence: Synthetic coding sequence
MAPKTKKGCKVTLPEKPVKLASHTRDTTGVSQMFPSSKARTKSLLGDDVFSTMAGLEEADAEVSGISEADPQALLQAMKDLDGMDADILGLKKSNSAPSKKAAKDPGKGELPNHPKPAGGAIPTKKSLPSPSSSGHQNRRFSSEDLEDPLRGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSQPLTSTQGLEHAAAGGSSGTTARERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 10298 - protein, 830 aa, Artificial Sequence
  Description of Artificial Sequence: Synthetic coding sequence
MAPKTKKGCKVTLPEKPVKLASHTRDTTGVSQMFPSSKARTKSLLGDDVFSTMAGLEEADAEVSGISEADPQALLQAMKDLDGMDADILGLKKSNSAPSKKAAKDPGKGELPNHPKPAGGAIPTKKSLPSPSSSGHQNRRFSSEDLEDPLRGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSQPLTSTQGLEHAAAGGSSGTTARERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMGRDEEGSLCAAHLPKAQLSGYAVEATRNQSQLQRFL

SEQ ID NO: 10299 - protein, 1134 aa, Artificial Sequence
  Description of Artificial Sequence: Synthetic coding sequence
MAPKTKKGCKVTLPEKPVKLASHTRDTTGVSQMFPSSKARTKSLLGDDVFSTMAGLEEADAEVSGISEADPQALLQAMKDLDGMDADILGLKKSNSAPSKKAAKDPGKGELPNHPKPAGGAIPTKKSLPSPSSSGHQNRRFSSEDLEDPLRGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSQPLTSTQGLEHAAAGGSSGTTARERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 10300 - protein, 1147 aa, Artificial Sequence
  Description of Artificial Sequence: Synthetic coding sequence
APKTKKGCKGSIDDFLGDLLGDDMTLPEKPVKLASHTRDTTGVSQMFPSSKARTKSLLGDDVFSTMAGLEEADAEVSGISEADPQALLQAMKDLDGMDADILGLKKSNSAPSKKAAKDPGKGELPNHPKPAGGAIPTKKSLPSPSSSGHQNRRFSSEDLEDPLRGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSQPLTSTQGLEHAAAGGSSGTTARERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 10301 - protein, 276 aa, Artificial Sequence
  Description of Artificial Sequence: Synthetic coding sequence
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYK

SEQ ID NO: 10302 - protein, 847 aa, Artificial Sequence
  Description of Artificial Sequence: Synthetic coding sequence
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHMYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 10303 - protein, 804 aa, Artificial Sequence
  Description of Artificial Sequence: Synthetic coding sequence
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHMYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLESIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 10304 - protein, 662 aa, Artificial Sequence
  Description of Artificial Sequence: Synthetic coding sequence
MALITLRKNLYRLSDFQMHRALAALKNKPLNHVHKVVKERLCPWLCSRQPEPFGVKFHHAHCKKFHSKNGNDLHPLGGPVFSQVSDCDRLEQNVKNEESQMFYRRLSNLTSSEEVLSFISTMETLPDTMAAGALQRICEVEKKDGDQGLPKEILENSIFQALCFQFEKEPSQLSNTSLVTALQALILLHVDPQSSLLLNLVAECQNRLRKGGMEVRNLCILGESLITLHSSGCVTLELIINQLQGEKLETFTPEDIVALYRILQACTEKVDEHQTFLNKINNFSLSIVSNLSPKLISQMLTALVVLDQSQAFPLIIKLGKYVVRHVPHFTNEELRRVLEAFIYFGHHDTFFTKALEHRVAAVCLTLDPEVVCRVMEYCSRELILSKPILNAVAETFVCQTEKFSPRQISALMEPFGKLNYLPPNASALFRKLENVLFTHFNYFPPKSLLKLLHSCSLNECHPVNFLAKIFKPLFLQRLQGKESHLDTLSRAQLTQLFLASVLECPFYKGPKLLPKYQVKSFLTPCCSLETPVDSQLYRYVKIGLTNLLGARLYFAPKVLTPYCYTIDVEIKLDEEGFVLPSTANEDIHKRIALCIDGPKRFCSNSKHLLGKEAIKQRHLQLLGYQVVQIPYHEIGMLKSRRELVEYLQRKLFSQNTVHWLQE

SEQ ID NO: 10305 - protein, 245 aa, Artificial Sequence
  Description of Artificial Sequence: Synthetic coding sequence
MALITLRKNLYRLSDFQMHRALAALKNKPLNHVHKVVKERLCPWLCSRQPEPFGVKFHHAHCKKFHSKNGNDLHPLGGPVFSQVSDCDRLEQNVKNEESQMFYRRLSNLTSSEEVLSFISTMETLPDTMAAGALQRICEVEKKDGDQGLPKEILENSIFQALCFQFEKEPSQLSNTSLVTALQALILLHVDPQSSLLLNLVAECQNRLRKGGMEVRNLCILGESLITLHSSGCVTLELIINQLQG

SEQ ID NO: 10306 - protein, 292 aa, Artificial Sequence
  Description of Artificial Sequence: Synthetic coding sequence
MERGPVVGAGLGAGARIQALLGCLLKVLLWVASALLYFGSEQAARLLGSPCLRRLYHAWLAAVVIFGPLLQFHVNPRTIFASHGNFFNIKFVNSAWGWTCTFLGGFVLLVVFLATRRVAVTARHLSRLVVGAAVWRGAGRAFLLIEDLTGSCFEPLPQGLLLHELPDRRSCLAAGHQWRGYTVSSHTFLLTFCCLLMAEEAAVFAKYLAHGLPAGAPLRLVFLLNVLLLGLWNFLLLCTVIYFHQYTHKVVGAAVGTFAWYLTYGSWYHQPWSPGSPGHGLFPRPHSSRKHN

SEQ ID NO: 10307 - protein, 262 aa, Artificial Sequence
  Description of Artificial Sequence: Synthetic coding sequence
MEHLERCEWLLRGTLVRAAVRRYLPWALVASMLAGSLLKELSPLPESYLSNKRNVLNVYFVKVAWAWTFCLLLPFIALTNYHLTGKAGLVLRRLSTLLVGTAIWYICTSIFSNIEHYTGSCYQSPALEGVRKEHQSKQQCHQEGGFWHGFDISGHSFLLTFCALMIVEEMSVLHEVKTDRSHCLHTAITTLVVALGILTFIWVLMFLCTAVYFHNLSQKVFGTLFGLLSWYGTYGFWYPKAFSPGLPPQSCSLNLKQDSYKK

SEQ ID NO: 10308 - protein, 350 aa, Artificial Sequence
  Description of Artificial Sequence: Synthetic coding sequence
MEPTEPMEPTEPMEPARSAHRGGEALLRELEVLVQDVVRTSSWWERHGVDCAILALSLFALPAGFLCLRWENALVFASGITILGVCHYTLTVKGSHLATHGALTESKRWSKIWLLFFVEVCTAFTAEHATHGHVKMHHAYTNVVGLGDSSTWRLPCLNRYVYMFLAPFLLPIATPLVAVERLRKVELGTALRTLALISLGLYSHYWLLLNVSGFKNPSSALGCMFLTRSLLAHPYLHVNIFQHIGLPMFSRDNKPRRIHMMSLGVLNLARLPVLDWAFGHSIISCHVEHHLFPRLSDNMCLKVKPVVSQFLREKQLPYNEDSYLARFQLFLRRYEEFMVQAPPITELVGL

SEQ ID NO: 10309 - protein, 204 aa, Artificial Sequence
  Description of Artificial Sequence: Synthetic coding sequence
MQGLRRWGCSPGSQRSCIAQLCLTGTPVSFLVPSSRCAQPSLQSTPRMGTSRCTMPTPTWWAWGTPARGGCLASTAMSTCSLLLSSSPSPLHWWLSHIGLPMFSRDNKPRRIHMMSLGVLNLARLPVLDWAFGHSIISCHVEHHLFPRLSDNMCLKVKPVVSQFLREKQLPYNEDSYLARFQLFLRRYEEFMVQAPPITELVGL

SEQ ID NO: 10310 - protein, 515 aa, Artificial Sequence
  Description of Artificial Sequence: Synthetic coding sequence
MVSIPEYYEGKNVLLTGATGFLGKVLLEKLLRSCPKVNSVYVLVRQKAGQTPQERVEEVLSGKLFDRLRDENPDFREKIIAINSELTQPKLALSEEDKEVIIDSTNIIFHCAATVRFNENLRDAVQLNVIATRQLILLAQQMKNLEVFMHVSTAYAYCNRKHIDEVVYPPPVDPKKLIDSLEWMDDGLVNDITPKLIGDRPNTYIYTKALAEYVVQQEGAKLNVAIVRPSIVGASWKEPFPGWIDNFNGPSGLFIAAGKGILRTIRASNNALADLVPVDVVVNMSLAAAWYSGVNRPRNIMVYNCTTGSTNPFHWGEVEYHVISTFKRNPLEQAFRRPNVNLTSNHLLYHYWIAVSHKAPAFLYDIYLRMTGRSPRMMKTITRLHKAMVFLEYFTSNSWVWNTENVNMLMNQLNPEDKKTFNIDVRQLHWAEYIENYCLGTKKYVLNEEMSGLPAARKHLNKLRNIRYGFNTILVILIWRIFIARSQMARNIWYFVVSLCYKFLSYFRASSTMRY

SEQ ID NO: 10311 - protein, 342 aa, Artificial Sequence
  Description of Artificial Sequence: Synthetic coding sequence
MVSIPEYYEGKNVLLTGATGFLGKVLLEKLLRSCPKVNSVYVLVRQKAGQTPQERVEEVLSGKLFDRLRDENPDFREKIIAINSELTQPKLALSEEDKEVIIDSTNIIFHCAATVRFNENLRDAVQLNVIATRQLILLAQQMKNLEVFMHVSTAYAYCNRKHIDEVVYPPPVDPKKLIDSLEWMDDGLVNDITPKLIGDRPNTYIYTKALAEYVVQQEGAKLNVAIVRPSIVGASWKEPFPGWIDNFNGPSGLFIAAGKGILRTIRASNNALADLVPVDVVVNMSLAAAWYSGVNRPRNIMVYNCTTGSTNPFHWGEVGMILPVFLNVRINLKEPRKKKKKK

SEQ ID NO: 10312 - protein, 515 aa, Artificial Sequence
  Description of Artificial Sequence: Synthetic coding sequence
MSTIAAFYGGKSILITGATGFLGKVLMEKLFRTSPDLKVIYILVRPKAGQTLQQRVFQILDSKLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIVSFCYKFLSYFRASSTLKV

SEQ ID NO: 10313 - protein, 515 aa, Artificial Sequence; identical to SEQ ID NO: 10312
  Description of Artificial Sequence: Synthetic coding sequence

SEQ ID NO: 10314 - protein, 202 aa, Artificial Sequence
  Description of Artificial Sequence: Synthetic coding sequence
MLLWSLLVIFERVRENLDSLTLVAPSSVFEGDSIVLKCQGEQNWKIQKMAYHKDNKELSVFKKFSDFLIQSAVLSDSGNYFCSTKGQLFLWDKTSNIVKIKVQGPDGYRRDLMTAGVLWGLFGVLGFTGVALLLYALFHKISGESSATNEPRGASRPNPQEFTYSSPTPDMEELQPVYVNANIRTLLENKDSQVIYSSVKKS

SEQ ID NO: 10315 - protein, 508 aa, Artificial Sequence
  Description of Artificial Sequence: Synthetic coding sequence
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 10316 - protein, 202 aa, Artificial Sequence
  Description of Artificial Sequence: Synthetic coding sequence
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQGPDGYRRDLMTAGVLWGLFGVLGFTGVALLLYALFHKISGESSATNEPRGASRPNPQEFTYSSPTPDMEELQPVYVNANIRTLLENKDSQVIYSSVKKS

SEQ ID NO: 10317 - protein, 444 aa, Artificial Sequence
  Description of Artificial Sequence: Synthetic coding sequence
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRTPKSSTLL

SEQ ID NO: 10318 - protein, 192 aa, Artificial Sequence
  Description of Artificial Sequence: Synthetic coding sequence
MWEWKICNSHGARPFAEPAGWEFVNLLRHHKSFLIAPLCLSVPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGCIYHLDSPYFAMTFPLLI

SEQ ID NO: 10319 - protein, 707 aa, Artificial Sequence
  Description of Artificial Sequence: Synthetic coding sequence
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKEQSSRFSMSL

SEQ ID NO: 10320 - protein, 734 aa, Artificial Sequence
  Description of Artificial Sequence: Synthetic coding sequence
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 10321 - protein, 742 aa, Artificial Sequence
  Description of Artificial Sequence: Synthetic coding sequence
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENILNPRKNKVQDFPCLCNT

SEQ ID NO: 10322 - protein, 734 aa, Artificial Sequence; identical to SEQ ID NO: 10320
  Description of Artificial Sequence: Synthetic coding sequence

SEQ ID NO: 10323 - protein, 515 aa, Artificial Sequence
  Description of Artificial Sequence: Synthetic coding sequence
MLLWASLLAFAPVCGQSAAAHKPVISVHPPWTTFFKGERVTLTCNGFQFYATEKTTWYHRHYWGEKLTLTPGNTLEVRESGLYRCQARGSPRSNPVRLLFSSDSLILQAPYSVFEGDTLVLRCHRRRKEKLTAVKYTWNGNILSISNKSWDLLIPQASSNNNGNYRCIGYGDENDVFRSNFKIIKIQELFPHPELKATDSQPTEGNSVNLSCETQLPPERSDTPLHFNFFRDGEVILSDWSTYPELQLPTVWRENSGSYWCGAETVRGNIHKHSPSLQIHVQRIPVSGVLLETQPSGGQAVEGEMLVLVCSVAEGTGDTTFSWHREDMQESLGRKTQRSLRAELELPAIRQSHAGGYYCTADNSYGPVQSMVLNVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEES

SEQ ID NO: 10324 - protein, 977 aa, Artificial Sequence
  Description of Artificial Sequence: Synthetic coding sequence
MLLWVILLVLVPSPGQFPRTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 10325 - protein, 977 aa, Artificial Sequence
  Description of Artificial Sequence: Synthetic coding sequence
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 10326 - protein, 124 aa, Artificial Sequence
  Description of Artificial Sequence: Synthetic coding sequence
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSEMGFPHAAQANVELLGSSDLLT

SEQ ID NO: 10327 - protein, 592 aa, Artificial Sequence
  Description of Artificial Sequence: Synthetic coding sequence
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTGKCWVLASHPPLAEFSLTHSFKNLFALSSFLP

SEQ ID NO: 10328 - protein, 759 aa, Artificial Sequence
  Description of Artificial Sequence: Synthetic coding sequence
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAGEWALPTSSTSEN

SEQ ID NO: 10329 - protein, 674 aa, Artificial Sequence
  Description of Artificial Sequence: Synthetic coding sequence
MLLWVILLVLAPVSGQFASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAGEWALPTSSTSEN

SEQ ID NO: 10330 - protein, 397 aa, Artificial Sequence
  Description of Artificial Sequence: Synthetic coding sequence
MLLWTAVLLFVPCVGKTVWLYLQAWPNPVFEGDALTLRCQGWKNTPLSQVKFYRDGKFLHFSKENQTLSMGAATVQSRGQYSCSGQVMYIPQTFTQTSETAMVQVQELFPPPVLSAIPSPEPREGSLVTLRCQTKLHPLRSALRLLFSFHKDGHTLQDRGPHPELCIPGAKEGDSGLYWCEVAPEGGQVQKQSPQLEVRVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKGSQVLFTPASNWLVPWLPASLLGLMVIAAALLVYVRSWRKAGPLPSQIPPTAPGGEQCPLYANVHHQKGKDEGVVYSVVHRTSKRSEGQFYHLCGGEMPAAQ

SEQ ID NO: 10331 - protein, 434 aa, Artificial Sequence
  Description of Artificial Sequence: Synthetic coding sequence
MLLWTAVLLFVPCVGKTVWLYLQAWPNPVFEGDALTLRCQGWKNTPLSQVKFYRDGKFLHFSKENQTLSMGAATVQSRGQYSCSGQVMYIPQTFTQTSETAMVQVQELFPPPVLSAIPSPEPREGSLVTLRCQTKLHPLRSALRLLFSFHKDGHTLQDRGPHPELCIPGAKEGDSGLYWCEVAPEGGQVQKQSPQLEVRVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKGSQVLFTPASNWLVPWLPASLLGLMVIAAALLVYVRSWRKAGPLPSQIPPTAPGGEQCPLYANVHHQKGKDEGVVYSVVHRTSKRSEARSAEFTVGRKDSSIICAEVRCLQPSEVSSTEVNMRSRTLQEPLSDCEEVLC

SEQ ID NO: 10332 - protein, 311 aa, Artificial Sequence
  Description of Artificial Sequence: Synthetic coding sequence
MLLWTAVLLFVPCVGKTVWLYLQAWPNPVFEGDALTLRCQGWKNTPLSQVKFYRDGKFLHFSKENQTLSMGAATVQSRGQYSCSGQVMYIPQTFTQTSETAMVQVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKGSQVLFTPASNWLVPWLPASLLGLMVIAAALLVYVRSWRKAGPLPSQIPPTAPGGEQCPLYANVHHQKGKDEGVVYSVVHRTSKRSEARSAEFTVGRKFYHLCGGEMPAAQ

SEQ ID NO: 10333 - protein, 526 aa, Artificial Sequence
  Description of Artificial Sequence: Synthetic coding sequence
MVNEGPNQEESDDTPVPESALQADPSVSVHPSVSVHPSVSINPSVSVHPSSSAHPSALAQPSGLAHPSSSGPEDLSVIKVSRRRWAVVLVFSCYSMCNSFQWIQYGSINNIFMHFYGVSAFAIDWLSMCYMLTYIPLLLPVAWLLEKFGLRTIALTGSALNCLGAWVKLGSLKPHLFPVTVVGQLICSVAQVFILGMPSRIASVWFGANEVSTACSVAVFGNQLGIAIGFLVPPVLVPNIEDRDELAYHISIMFYIIGGVATLLLILVIIVFKEKPKYPPSRAQSLSYALTSPDASYLGSIARLFKNLNFVLLVITYGLNAGAFYALSTLLNRMVIWHYPGEEVNAGRIGLTIVIAGMLGAVISGIWLDRSKTYKETTLVVYIMTLVGMVVYTFTLNLGHLWVVFITAGTMGFFMTGYLPLGFEFAVELTYPESEGISSGLLNISAQVFGIIFTISQGQIIDNYGTKPGNIFLCVFLTLGAALTAFIKADLRRQKANKETLENKLQEEEEESNTSKVPTAVSEDHL

SEQ ID NO: 10334 - protein, 321 aa, Artificial Sequence
  Description of Artificial Sequence: Synthetic coding sequence
MSADNSSTICVCRSVRQELGIAIGFLVPPVLVPNIEDRDELAYHISIMFYIIGGVATLLLILVIIVFKEKPKYPPSRAQSLSYALTSPDASYLGSIARLFKNLNFVLLVITYGLNAGAFYALSTLLNRMVIWHYPGEEVNAGRIGLTIVIAGMLGAVISGIWLDRSKTYKETTLVVYIMTLVGMVVYTFTLNLGHLWVVFITAGTMGFFMTGYLPLGFEFAVELTYPESEGISSGLLNISAQVFGIIFTISQGQIIDNYGTKPGNIFLCVFLTLGAALTAFIKADLRRQKANKETLENKLQEEEEESNTSKVPTAVSEDHL

SEQ ID NO: 10335 - protein, 1857 aa, Artificial Sequence
  Description of Artificial Sequence: Synthetic coding sequence
MFGLKVKKKRNKAEKGLILANKAAKDSQGDTEALQEEPSHQEGPRGDLVHDDASIFPVPSASPKRRSKLLTKIHDGEVRSQNYQIAITITEARQLVGENIDPVVTIEIGDEKKQSTVKEGTNSPFYNEYFVFDFIGPQVHLFDKIIKISVFHHKLIGSVLIGSFKVDLGTVYNQPGHQFCNKWALLTDPGDIRTGTKGYLKCDISVMGKGDVLKTSPKTSDTEEPIEKNLLIPNGFPLERPWARFYVRLYKAEGLPKMNSSIMANVTKAFVGDSKDLVDPFVEVSFAGQMGRTTVQKNCADPVWHEQVIFKEMFPPLCRRVKIQVWDEGSMNDVALATHFIDLKKISNEQDGDKGFLPTFGPAWINLYGSPRNHSLMDDYQEMNEGFGEGVSFRGRILVEIAVEILSGRAQESKFSKALKELKLPSKDKDSKSSKGKDKADKTEDGKSQQASNKTNSTEVEVESFDVPPEIVPEKNEEFLLFGAFFEATMIDRKIGDKPISFEVSIGNFGNLIDGGSHHGSKKSAESAEEDLLPLLHEGQGDVAHDVPIPMASTTHPEKPLVTEGNRNYNYLPFEAKKPCVYFISSWGDQTFRLHWSNMLEKMADFLEESIEEVRELIKISQEAPEEKMKTVLSDFISRSSAFISEAEKKPKMLNQTTLDKKRLTLCWQELEAMCKEAKGIIQQQKKKLSVDEMIHEAQNFVEKIRFLVDEPQHTIPDVFIWMLSNNRRVAYARIASKDLLYSPVAGQMGKHCGKIKTHFLKPPGKRPAGWSVQAKVDVYLWLGSIKHASAILDNLPVGYEAEMSSKGAGTNHPPSNLLYQEQHVFQLRAHMYQARGLIAADSNGLSDPFAKVTFLSHCQTTKIISQTLSPTWNQMLLFNDLVLHGDVKELAESPPLVVVELYDSDAVGKPEYLGATVAAPVVKLADQDYEPPRLCYHPIFCGNLSGGDLLAVFELLQVPPSGLQGLPPVEPPDITQIYPVPANIRPVLSKYRVEVLFWGVREMKKVQLLSVDRPQALIECGGQGVKSCVIQSYKNNPNFSIQADAFEVELPENELLHPPLSICVVDWRAFGRSTLVGTYTINYLKQFLCKLREPLAPITQVDGTQPGHDISDSLTATESSGAHSSSQDPPADHIYVDVEPPPTVVPDSAQAQPAILVDVPDSSPMLEPEHTPVAQEPPKDGKPKDPRKPSRRSTKRRKRTIADESAENVIDWWSKYYASLKKAQKAKERNPKGKKGNTEAKPDEVVVDIEDGPKKKKDKMLKKKPKDDGIPNLAILQIYDGDLESEFNNFEDWVKTFELFRGKSTEDDHGLDGDRVIGKFKGSFCIYKSPQDSSSEDSGQLRIQQGIPPNHPVTVLIRVYIVAAFNLSPADPDGKSDPYIVIKLGKTEIKDRDKYIPKQLNPVFGRSFEIQATFPKESLLSILIYDHDMIGTDDLIGETKIDLENRFYSKHRAICGLQSQYEIEGYNAWRDTSKPTEILTKLCKDNKLDGPYFHPGKIQIGNQVFSGKTIFTEEDTDETVESYEHLALKVLHSWEDIPEVGCRLVPEHIETRPLYHKDKPGMEQGRLQMWVDMFPKDMPQPGPPVDISPRRPKGYELRVTIWNTEDVILEDENIFTGQKSSDIYVKGWLKGLEDDKQETDVHYNSLTGEGNFNWRFLFPFQYLPAEKQMVITKRENIFSLEKMECKTPAVLVLQVWDFERLSSDDFLGTLEMNLNSFPRAAKSAKACDLAKFENASEETKISIFQQKRVRGWWPFSKSKELTGKVEAEFHLVTAEEAEKNPVGKARKEPEPLAKPNRPDTSFSWFMSPFKCLYYLIWKNYKKYIIIAFILIILIIFLVLFIYTLPGAISRRIVVGS

SEQ ID NO: 10336 - protein, 1857 aa, Artificial Sequence; identical to SEQ ID NO: 10335
  Description of Artificial Sequence: Synthetic coding sequence

SEQ ID NO: 10337 - protein, 62 aa, Artificial Sequence
  Description of Artificial Sequence: Synthetic coding sequence
MEELETSLFQTRKAHRIEQMVARWLRRSRDSSARAKVAAADGPARNPTQTLIPVRHTVKIDK

SEQ ID NO: 10338 - protein, 1578 aa, Artificial Sequence
  Description of Artificial Sequence: Synthetic coding sequence
MEELETSLFQTRKAHRIEQMVARWLRRSRDSSARAKVAAADGPARNPTQTLIPVRHTVKIDKDTLLQDYGFHISESLPLTVVAVTAGGSAHGKLFPGDQILQMNNEPAEDLSWERAVDILREAEDSLSITVVRCTSGVPKSSFLTEEKRARLKTNPVKVHFAEEVLISGHSQGNSLLCMPNVLKLYLENGQTKAFKFEANTTVKDIILTVKEKLSIRSIEYFALALEEQYSISRLHLLHEEELIQQVVEREESHDYRCLFRVCFVPKDPLDLLKEDPVAFEYLYLQSCSDVLQERFAVEMKCSSALRLAALHIQERIYACAQPQKISLKYIEKDWGIENFISPTLLRNMKGKDIKKAISFHMKRNQNLLEPRQKQLISAAQLRLNYLQILGELKTYGGRIFNATLMLQDRESYIALLVGAKYGISQVINSKLNIMSTLAEFANISRVELTEESEKVSVVKVYLQDVKVLTLLLESNSAKDLACLIAGYYRLLVDPVTSIFLWPGNKQQAHRVSAEEGYESRACSDSEESSEVDCVLEPLSDRRLVKLAPCRSLIKEEQPPGNSPTPEVARRGPSTCGASSTTDSAESEASDSANTESRGYRTSGSSESMDALEEDDLDTCSSSRSTFFHFGSPGLAESIDSDSQEERSGIETSGFLCLLDLAQRANPQCQKTEFSESAALETFGWAPELSTVRLDPRLYEGSHADYYSLCSSVSPASYLSDSSESTASRQGGAPPAWGQQGWTEAQPSSMLEPLALHPPLAFEDGSSDEEYYDAADKLTPPGPPSGPRDVSTAEPSATSLQNKASTSSPENSLPCGPDGRQPSRRGGVKKYAKTLRKRRSFLQTDYTSQVSFPLVPSASLESVDDVCYYDREPYLALGAPSPTVSSLQDMQGEPGLLETKALGLLAPLRETKSTNPASRVMEMEPETMETKSVIDSRVSSISAIRFRIDPNNKENSGVVPAASSSASTPHCSNPGSSGPDTAQARPSQILPLSQDLDGIAPKEPTIEHGDSSFSLSSGDPNPDRACLASNPGLNNVSQGDTLELQLEPHVQLEMGLESFCTNHIQETAPKYTEPLLSPRDEPRSDECGINPGEKIASIPTKEEPQGQLSLERDREVTNKNGTNVFQEESRKDSGDSPGDVSNNVSQTLDISSPAGKIVTSLSLDAPVTGTEQIPPHPPRDPQGQSREPPGQGCQAQEQKLFVELDLDPDFFLGKQTVSPAVPPEGIKAEAPNHVTGQDIAPRDSPEWVCFNPEPSLPEPLPCPQEDPHLETSNHCLLSEGKSDSSSICLSAEKSFLCFAPESHPEVSASLRVATSLGFAGMNEMVAPRIGMDQCSCQFSYATCFRGPQPETEEEDRDLEAHPMAPLTSPPSAGSPVVLPWRPARAHSCTTAPLSRKSHIWPEYCSRALRQLKATPASTPEGFIQLMESLLELQDILETSWGVGNKHPPEKCTWHFTESRSRLCMGSQKLLSSCRHVIRMDQSPEEMQGAVRDTFQHLVQLAGLCFQFTDCSRCSARHREAAGNLRDVVYTYHQFIEAAKSTCERGYHDLSVKLLARQCTALTAAVFCLTQKFRASTAL

SEQ ID NO: 10339 - protein, 634 aa, Artificial Sequence
  Description of Artificial Sequence: Synthetic coding sequence
MPNVLKLYLENGQTKAFKFEANTTVKDIILTVKEKLSIRSIEYFALALEEQYSISRLHLLHEEELIQQVVEREESHDYRCLFRVCFVPKDPLDLLKEDPVAFEYLYLQSCSDVLQERFAVEMKCSSALRLAALHIQERIYACAQPQKISLKYIEKDWGIENFISPTLLRNMKGKDIKKAISFHMKRNQNLLEPRQKQLISAAQLRLNYLQILGELKTYGGRIFNATLMLQDRESYIALLVGAKYGISQVINSKLNIMSTLAEFANISRVELTEESEKVSVVKVYLQDVKVLTLLLESNSAKDLACLIAGYYRLLVDPVTSIFLWPGNKQQAHRVSAEEGYESRACSDSEESSEVDCVLEPLSDRRLVKLAPCRSLIKEEQPPGNSPTPEVARRGPSTCGASSTTDSAESEASDSANTESRGYRTSGSSESMDALEEDDLDTCSSSRSTFFHFGSPGLAESIDSDSQEERSGIETSGFLCLLDLAQRANPQCQKTEFSESAALETFGWAPELSTVRLDPRLYEGSHADYYSLCSSVSPASYLSDSSESTASRQGGAPPAWGQQGWTEAQPSSMLEPLALHPPLAFEDGSSDEEYYDAADKLTPPGPPSGEPSLAGLQTRQAAPECLPGIKAWGQA

SEQ ID NO: 10340 - protein, 1578 aa, Artificial Sequence; identical to SEQ ID NO: 10338
  Description of Artificial Sequence: Synthetic coding sequence

SEQ ID NO: 10341 - protein, 681 aa, Artificial Sequence
  Description of Artificial Sequence: Synthetic coding sequence
MAEVGGVPKSSFLTEEKRARLKTNPVKVHFAEEVLISGHSQGNSLLCMPNVLKLYLENGQTKAFKFEANTTVKDIILTVKEKLSIRSIEYFALALEEQYSISRLHLLHEEELIQQVVEREESHDYRCLFRVCFVPKDPLDLLKEDPVAFEYLYLQSCSDVLQERFAVEMKCSSALRLAALHIQERIYACAQPQKISLKYIEKDWGIENFISPTLLRNMKGKDIKKAISFHMKRNQNLLEPRQKQLISAAQLRLNYLQILGELKTYGGRIFNATLMLQDRESYIALLVGAKYGISQVINSKLNIMSTLAEFANISRVELTEESEKVSVVKVYLQDVKVLTLLLESNSAKDLACLIAGYYRLLVDPVTSIFLWPGNKQQAHRVSAEEGYESRACSDSEESSEVDCVLEPLSDRRLVKLAPCRSLIKEEQPPGNSPTPEVARRGPSTCGASSTTDSAESEASDSANTESRGYRTSGSSESMDALEEDDLDTCSSSRSTFFHFGSPGLAESIDSDSQEERSGIETSGFLCLLDLAQRANPQCQKTEFSESAALETFGWAPELSTVRLDPRLYEGSHADYYSLCSSVSPASYLSDSSESTASRQGGAPPAWGQQGWTEAQPSSMLEPLALHPPLAFEDGSSDEEYYDAADKLTPPGPPSGEPSLAGLQTRQAAPECLPGIKAWGQA

SEQ ID NO: 10342 - protein, 570 aa, Artificial Sequence
  Description of Artificial Sequence: Synthetic coding sequence
MLSRLMSGSSRSLEREYSCTVRLLDDSEYTCTIQRDAKGQYLFDLLCHHLNLLEKDYFGIRFVDPDKQRHWLEFTKSVVKQLRSQPPFTMCFRVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYVSQKEEKKIILTYFAPTPEACKHLWKCGIENQAFYKLEKSSQVRTVSSSNLFFKGSRFRYSGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQVNKFVLSVLRLLLVTMGLLFVLLLLLIILTESDLDIAFFRDIRQTPEFEQFHYQYFCPLRRWFACKIRSVVSLLIDT

SEQ ID NO: 10343 - protein, 414 aa, Artificial Sequence
  Description of Artificial Sequence: Synthetic coding sequence
MCFRVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYEKKIILTYFAPTPEACKHLWKCGIENQAFYKLEKSSQVRTVSSSNLFFKGSRFRYSGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQAMVCLQNPLSGEPAH

SEQ ID NO: 10344 - protein, 622 aa, Artificial Sequence
  Description of Artificial Sequence: Synthetic coding sequence
MNKLNFHNNRVMQDRRSVCIFLPNDESLNIIINVKILCHQLLVQVCDLLRLKDCHLFGLSVIQNNEHVYMELSQKLYKYCPKEWKKEASKVRQYEVTWGIDQFGPPMIIHFRVQYYVENGRLISDRAARYYYYWHLRKQVLHSQCVLREEAYFLLAAFALQADLGNFKRNKHYGKYFEPEAYFPSWVVSKRGKDYILKHIPNMHKDQFALTASEAHLKYIKEAVRLDDVAVHYYRLYKDKREIEASLTLGLTMRGIQIFQNLDEEKQLLYDFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 10345 - protein, 614 aa, Artificial Sequence
  Description of Artificial Sequence: Synthetic coding sequence
MNKLNFHNNRVMQDRRSVCIFLPNDESLNIIINVKILCHQLLVQVCDLLRLKDCHLFGLSVIQNNEHVYMELSQKLYKYCPKEWKKEASKGIDQFGPPMIIHFRVQYYVENGRLISDRAARYYYYWHLRKQVLHSQCVLREEAYFLLAAFALQADLGNFKRNKHYGKYFEPEAYFPSWVVSKRGKDYILKHIPNMHKDQFALTASEAHLKYIKEAVRLDDVAVHYYRLYKDKREIEASLTLGLTMRGIQIFQNLDEEKQLLYDFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 10346 - protein, 614 aa, Artificial Sequence; identical to SEQ ID NO: 10345
  Description of Artificial Sequence: Synthetic coding sequence

SEQ ID NO: 10347 - protein, 264 aa, Artificial Sequence
  Description of Artificial Sequence: Synthetic coding sequence
MDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 10348 - protein, 61 aa, Artificial Sequence
  Description of Artificial Sequence: Synthetic coding sequence
MNKLNFHNNRVMQDRRSVCIFLPNDESLNIIINVKILCHQLLVQVCDLLRLKDCHLFGLSV

SEQ ID NO: 10349 - protein, 1045 aa, Artificial Sequence
  Description of Artificial Sequence: Synthetic coding sequence
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGREFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 10350 - protein, 129 aa, Artificial Sequence
  Description of Artificial Sequence: Synthetic coding sequence
MGEIEQRPTPGSRLGAPENSGISTLERGQKPPPTPSGKLVSIKIQMLDDTQEAFEVPMVSSSSFLKATGSSWTGWVLRCSMKPKHHSHLIEKFGEDRILTHLTGSISYTNWAGSRSLAVTVTEELLNLF

SEQ ID NO: 10351 - protein, 360 aa, Artificial Sequence
  Description of Artificial Sequence: Synthetic coding sequence
MASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKAGVQWRDLGSLQPPPPRFKP

SEQ ID NO: 10352 - protein, 1076 aa, Artificial Sequence
  Description of Artificial Sequence: Synthetic coding sequence
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGRPGSFSLIRTPHLGQARRIPCAPERRPLLLVKEFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 10353 - protein, 153 aa, Artificial Sequence
  Description of Artificial Sequence: Synthetic coding sequence
  MOD_RES (1)..(1): Any amino acid
XLCKHHPPSHADFRDCRAALAEITEMVAQLHGTMIKMENFQKLHELKKDLIGIDNLVVPGRVSSSGLTMHCAGSRKEASEGLTFEPFEERPLQSKMSSFHPPGRQLEKHNSVVSSESLCSEEIKQSSDLIFCFFSLRGDSLLYLFPYHIPQKI

SEQ ID NO: 10354 - protein, 184 aa, Artificial Sequence
  Description of Artificial Sequence: Synthetic coding sequence
  MOD_RES (1)..(1): Any amino acid
XSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKAGVQWRDLGSLQPPPPRFKP

SEQ ID NO: 10355 - protein, 1054 aa, Artificial Sequence
  Description of Artificial Sequence: Synthetic coding sequence
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKEFTSYFQRHDEVLTELEKATKRCKKLEAVYKEFELQKVCYLPLNTFLLKPIQRLLHYRLLLRRLCGHYSPGHHDYADCHDALKAITEVTTTLQHILIRLENLQKLTELQRDLVGIENLIAPGREFIREGCLHKLTKKGLQQRMFFLFSDMLLYTSKGVAGTSHFRIRGLLPLQGMLVEESDNEWSVPHCFTIYAAQKTIVVAASTRLEKEKWMLDLNSAIQAAKSGGDTAPALPGRTVCTRPPRSPNEVSLEQESEDDARGVRSSLEGHGQHRANTTMHVCWYRNTSVSRADHSAAVENQLSGYLLRKFKNSHGWQKLWVVFTNFCLFFYKTHQDDYPLASLPLLGYSVSIPREADGIHKDYVFKLQFKSHVYFFRAESKYTFERWMEVIQGASSSAGRAPSIVQDGPQPSSGLEGMVRGKEE

SEQ ID NO: 10356 - protein, 647 aa, Artificial Sequence
  Description of Artificial Sequence: Synthetic coding sequence
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKVFQLHEGHVAGVTKME

SEQ ID NO: 10357 - protein, 56 aa, Artificial Sequence
  Description of Artificial Sequence: Synthetic coding sequence
  MOD_RES (1)..(1): Any amino acid
XKSHVYFFRAESKYTFERWMEVIQGASSSAGRAPSIVQDGPQPSSGLEGMVRGKEE

SEQ ID NO: 10358 - protein, 134 aa, Artificial Sequence
  Description of Artificial Sequence: Synthetic coding sequence
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEE

SEQ ID NO: 10359 - protein, 93 aa, Artificial Sequence
  Description of Artificial Sequence: Synthetic coding sequence
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQ

SEQ ID NO: 10360 - protein, 638 aa, Artificial Sequence
  Description of Artificial Sequence: Synthetic coding sequence
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKAAHEFTT

SEQ ID NO: 10361 - protein, 677 aa, Artificial Sequence
  Description of Artificial Sequence: Synthetic coding sequence
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYFKKKKKKDKNNKEPIIEDILNLESSPTASGSSVSPGLYSKTMTPIYDPINGTPASSTMTWFSDSPLTEQNCSILAFSQPPQSPEALADMYQPRSLVDKAKLNAGWLDSSRSLMEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKRHKSKQLAARILEAHQNVAQMPLVEAKLRFIQAWQSLPEFGLTYYLVRFKGSKKDDILGVSYNRLIKIDAATGIPVTTWRFTNIKQWNVNWETRQVVIEFDQNVFTAFTCLSADCKIVHEYIGGYIFLSTRSKDQNETLDEDLFHKLTGGQD

SEQ ID NO: 10362 - protein, 555 aa, Artificial Sequence
  Description of Artificial Sequence: Synthetic coding sequence
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYFKKKKKKDKNNKEPIIEDILNLESSPTASGSSVSPGLYSKTMTPIYDPINGTPASSTMTWFSDSPLTEQNCSILAFSQPPQSPEALADMYQPRSLVDKAKLNAGWLDSSRSLMEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKRHKSKQLAARILEAHHLQAPFHSYRSLSHL

SEQ ID NO: 10363 - protein, 146 aa, Artificial Sequence
  Description of Artificial Sequence: Synthetic coding sequence
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYF

SEQ ID NO: 10364 - protein, 420 aa, Artificial Sequence
  Description of Artificial Sequence: Synthetic coding sequence
MEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKRHKSKQLAARILEAHQNVAQMPLVEAKLRFIQAWQSLPEFGLTYYLVRFKGSKKDDILGVSYNRLIKIDAATGIPVTTWRFTNIKQWNVNWETRQVVIEFDQNVFTAFTCLSADCKIVHEYIGGYIFLSTRSKDQNETLDEDLFHKLTGGQD

SEQ ID NO: 10365 - protein, 183 aa, Artificial Sequence
  Description of Artificial Sequence: Synthetic coding sequence
MAASMARGGVSARVLLQAARGTWWNRPGGTSGSGEGVALGTTRKFQATGSRPAGEEDAGGPERPGDVVNVVFVDRSGQRIPVSGRVGDNVLHLAQRHGVDLEGACEASLACSTCHVYVSEDHLDLLPPPEEREDDMLDMAPLLQENSRLGCQIVLTPELEGAEFTLPKITRNFYVDGHVPKPH

SEQ ID NO: 10366 - protein, 145 aa, Artificial Sequence
  Description of Artificial Sequence: Synthetic coding sequence
MHVMAASMARGGVSARVLLQAARGTWWNRPGGTSGSGEGVALGTTRKFQATGSRPAGEEDAGGPERPGDVVNVVFVDRSGQRIPVSGRVGDNVLHLAQRHGVDLEGACEASLACSTCHVYVSEDHLDLLPPPEERRTRGWAARLC

SEQ ID NO: 10367 - protein, 183 aa, Artificial Sequence
  Description of Artificial Sequence: Synthetic coding sequence
MAGGPPNTKAEMEMSLAEELNHGRQGENQEHLVIAEMMELGSRSRGASQKKQKLEQKAAGSASAKRVWNMTATRPKKMGSQLPKPRMLRESGHGDAHLQEYAGNFQGIRFHYDRNPGTDAVAQTSLEEFNVLEMEVMRRQLYAVNRRLRALEEQGATWRHRETLIIAVLVSASIANLWLWMNQ

SEQ ID NO: 10368 - protein, 508 aa, Artificial Sequence
  Description of Artificial Sequence: Synthetic coding sequence
MGSCCSCPDKDTVPDNHRNKFKVINVDDDGNELGSGIMELTDTELILYTRKRDSVKWHYLCLRRYGYDSNLFSFESGRRCQTGQGIFAFKCARAEELFNMLQEIMQNNSINVVEEPVVERNNHQTELEVPRTPRTPTTPGFAAQNLPNGYPRYPSFGDASSHPSSRHPSVGSARLPSVGEESTHPLLVAEEQVHTYVNTTGVQEERKNRTSVHVPLEARVSNAESSTPKEEPSSIEDRDPQILLEPEGVKFVLGPTPVQKQLMEKEKLEQLGRDQVSGSGANNTEWDTGYDSDERRDAPSVNKLVYENINGLSIPSASGVRRGRLTSTSTSDTQNINNSAQRRTALLNYENLPSLPPVWEARKLSRDEDDNLGPKTPSLNGYHNNLDPMHNYVNTENVTVPASAHKIEYSRRRDCTPTVFNFDIRRPSLEHRQLNYIQVDLEGGSDSDNPQTPKTPTTPLPQTPTRRTELYAVIDIERTAAMSNLQKALPRDDGTSRKTRHNSTDLPM

SEQ ID NO: 10369 - protein, 508 aa, Artificial Sequence; identical to SEQ ID NO: 10368
  Description of Artificial Sequence: Synthetic coding sequence

SEQ ID NO: 10370 - protein, 36 aa, Artificial Sequence
  Description of Artificial Sequence: Synthetic coding sequence
MGSCCSCPDKDTVPDNHRNKFKVINVDDDGNELGSG

SEQ ID NO: 10371 - protein, 40 aa, Artificial Sequence
  Description of Artificial Sequence: Synthetic coding sequence
MGSCCSCPDKDTVPDNHRNKFKVINVDDDGNELGSGIMEL

SEQ ID NO: 10372 - protein, 33 aa, Artificial Sequence
  Description of Artificial Sequence: Synthetic coding sequence
MGSCCSCPDKDTVPDNHRNKFKVINVDDDGNEL

SEQ ID NO: 10373 - protein, 508 aa, Artificial Sequence; identical to SEQ ID NO: 10368
  Description of Artificial Sequence: Synthetic coding sequence

SEQ ID NO: 10374 - protein, 10 aa, Artificial Sequence
  Description of Artificial Sequence: Synthetic coding sequence
MGSCCSCPDK

SEQ ID NO: 10375 - protein, 12 aa, Artificial Sequence
  Description of Artificial Sequence: Synthetic coding sequence
MGSCCSCPDKDT

SEQ ID NO: 10376 - protein, 508 aa, Artificial Sequence; identical to SEQ ID NO: 10368
  Description of Artificial Sequence: Synthetic coding sequence

SEQ ID NO: 10377 - protein, 91 aa, Artificial Sequence
  Description of Artificial Sequence: Synthetic coding sequence
MGSCCSCPDKDTVPDNHRNKFKVINVDDDGNELGSGIMELTDTELILYTRKRDSVKWHYLCLRRYGYDSNLFSFESGRRCQTGQGIFAFKC

SEQ ID NO: 10378 - protein, 183 aa, Artificial Sequence
  Description of Artificial Sequence: Synthetic coding sequence
MGSCCSCPDKDTVPDNHRNKFKVINVDDDGNELGSGIMELTDTELILYTRKRDSVKWHYLCLRRYGYDSNLFSFESGRRCQTGQGIFAFKCARAEELFNMLQEIMQNNSINVVEEPVVERNNHQTELEVPRTPRTPTTPGFAAQNLPNGYPRYPSFGDASSHPSSRHPSVGSARLPSVGEEST

SEQ ID NO: 10379 - protein, 492 aa, Artificial Sequence
  Description of Artificial Sequence: Synthetic coding sequence
MGSCCSCLNRDSVPDNHPTKFKVTNVDDEGVELGSGVMELTQSELVLHLHRREAVRWPYLCLRRYGYDSNLFSFESGRRCQTGQGIFAFKCSRAEEIFNLLQDLMQCNSINVMEEPVIITRNSHPAELDLPRAPQPPNALGYTVSSFSNGCPGEGPRFSAPRRLSTSSLRHPSLGEESTHALIAPDEQSHTYVNTPASEDDHRRGRHCLQPLPEGQAPFLPQARGPDQRDPQVFLQPGQVKFVLGPTPARRHMVKCQGLCPSLHDPPHHNNNNEAPSECPAQPKCTYENVTGGLWRGAGWRLSPEEPGWNGLAHRRAALLHYENLPPLPPVWESQAQQLGGEAGDDGDSRDGLTPSSNGFPDGEEDETPLQKPTSTRAAIRSHGSFPVPLTRRRGSPRVFNFDFRRPGPEPPRQLNYIQVELKGWGGDRPKGPQNPSSPQAPMPTTHPARSSDSYAVIDLKKTVAMSNLQRALPRDDGTARKTRHNSTDLPL

SEQ ID NO: 10380 - protein, 492 aa, Artificial Sequence; identical to SEQ ID NO: 10379
  Description of Artificial Sequence: Synthetic coding sequence

SEQ ID NO: 10381 - protein, 36 aa, Artificial Sequence
  Description of Artificial Sequence: Synthetic coding sequence
MGSCCSCLNRDSVPDNHPTKFKVTNVDDEGVELGSG

SEQ ID NO: 10382 - protein, 147 aa, Artificial Sequence
  Description of Artificial Sequence: Synthetic coding sequence
METPRRARSPVSPQFPGQAGCSDTMGSCCSCLNRDSVPDNHPTKFKVTNVDDEGVELGSGVMELTQSELVLHLHRREAVRWPYLCLRRYGYDSNLFSFESGRRCQTGQGIFAFKCSRAEEIFNLLQDLMQCNSINVMEEPVIITRNS

SEQ ID NO: 10383 - protein, 1134 aa, Artificial Sequence
  Description of Artificial Sequence: Synthetic coding sequence
MMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 10384 - protein, 1142 aa, Artificial Sequence
  Description of Artificial Sequence: Synthetic coding sequence
MSGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 10385 - protein, 1198 aa, Artificial Sequence
  Description of Artificial Sequence: Synthetic coding sequence
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 10386 - protein, 1198 aa, Artificial Sequence; identical to SEQ ID NO: 10385
  Description of Artificial Sequence: Synthetic coding sequence

SEQ ID NO: 10387 - protein, 684 aa, Artificial Sequence
  Description of Artificial Sequence: Synthetic coding sequence
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQTPSG

SEQ ID NO: 10388 - protein, 224 aa, Artificial Sequence
  Description of Artificial Sequence: Synthetic coding sequence
MNIEVGNISYTGAIISWSSSEPCLEDYYHIMYRPNWNSIFSGYLRYSFHHEEKVPRTISSVVLEHLAPSTLYFLCISCKKAAFPYRHYCTMFHTLDKSPLAPGSSLVDPQISLWVLMAILLACFTAVLAFICLQFWCVRCHEPRWSYRAGHMEEANGLVRWPEEAPDLGQREEDLQGLPLVEMPRKNSRDGAELDPEANQDAPDAGALQRGGGDPPAILPHCGE

SEQ ID NO: 10389 - protein, 180 aa, Artificial Sequence
  Description of Artificial Sequence: Synthetic coding sequence
MNIEVGNISYTGAIISWSSSEPCLEDYYHIMYRPNWNSIFSGYLRYSFHHEEKVPRTISSVVLEHLAPSTLYFLCISCKKAAFPYRHYCTMFHTLDKSPLAPGSSLVDPQISLWVLMAILLACFTAVLAFICLQFWCVRCHEPRWSYRAGHMEEANGLVRWPEEAPDLGQREEDLQGLPL

SEQ ID NO: 10390 - protein, 3466 aa, Artificial Sequence
  Description of Artificial Sequence: Synthetic coding sequence
MELYLGACSKPAKVAVTKTVASVLAADTQQCRDGVHKTHFAGVGPAQLLDLPLGVKLPVIPGSNAVFYTTNFGEKLFRPSYGFNLTDPYCRLLENQYKSLHDPHLKAYYKRKDILKRLKKGGYITSNNKVVCTLRELNKYRQYLTSLKLDFERNYIKEQRILAKQLHNIPENNQIPQHCDVAQVQNWLLKEGTESIKDQERLMRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHASPKNKKKTSEDIMLVYPAGDQNTYKETHGHTANAAHQRQNSSNNFTKKNSASVVYQADVQDNGINQKRDGMVSKNSSIFDDRGGINISGQGSIISAQVSPTRNFSRVSQAFLDPSKEEKETNADWDGRPTKRSSYLCESGPQAHATDPGIFSSPVYTNMQQNLLQNCLQEKVTSEELNIIIQNVMTWVVATVTSILYPAITKYEKRLQNNTYPVSDDSILSSDSSSFCSTCSEDFTYRSYTSATTKTFQAEPCAFVVDTSVRRPTTPIKPPPAHVEKTVVGKTCHIKGQSIISKHKYNKTNLLYSYPKLRSCKSDSHLLASFETGTKKSKDATTETDSLGSSLHCDKTAKAMDEMKNLKNVFVNFKCYLKGETEVILESILREIMSDLTQAIPSLSSVTAEVFVEQCEREKEILLSNAHIPSVASEIVENMLEKLESAVEKKCVEMFSQDLSVDIKPSLAASDELLTSSNGKPLKNSMPHTLDPMCDIAEDMVHAILEKLMTLVSFKQNEFLHLKDTNKLSCQQHKTDPICMFLQRAGKNKSSLESDEASLIVNEEVQNLISNIFSQSSLVAYIEEAINAILGYIQTELNNERIIASEETVVLLQLLEDILFQLHQEPVNESFQKSRQPRISSPSDTKEKYRLTGTRLSNSPRSGRPFPPINVPGMVLYSDDENEEIDNIVKNVLDSTFKDEKVKSQEQIPNHWFTKGNTCFECKRNIKPPTKPGSRSKAAFHDWELKTEPPSTNHEDILKKKLSSNKDISTFSQDQKHQIEKASENIVTSILKEMLKDISSVPFGHLDSKTGSEASVLVSEKPQGLSHQEWIDQMFSVSEISTVAQEITDSVLNILHKASNYISNTTKSSISSSVHQISLHNSDTEHIVKEAPNKYPLKTWFDSEKKMKYLSLFDVDPEKPPWLKSGKSEPKPVDDINDKIIRTIFKRLKSFICPKLHMGFKSSLRSQLSKYTAKIVNIVLCAIQNELELHKENLNLREIDHTKSLTDKGFFANTDKKLESLVTSIDDDILASPLLTCIYDMLLSSENAHQRSISLSSRKPKSATDSVDVQSILPNRQDKKSFHKYLATPCTHHSVNGGNHIKENAKLQVLERIGETLHEMLSKLLGTHLHSQLSCSQQSREMTNKNQKMAAALQSNIQLISKAILDYILAKLCGVDMDTSFASCGLKAISESLDIDNPSFASIIEKMAKSTKIISSIVSRRVQEDNKEETKSKAKPVAPVSSKTPSTKEMHPNKLKAVASDILNMVFAKLEGFANGHLEILGAINDGNKKSNKIGWEYESTNISRDTHEASFLSALYMHAKKVSSAILKVIQTELNVTSSDLKTSVENPPPETQILKYVVKLILDAVSSDMFNEMESEGGGIETYRYRPTYGSLPGGAESDSFLEDDAYTAKKIIDERSPQREEVKTRSLKQWALEKTLNKIEVKLKEPHISPIAPIIRNILNEIFQSTLINQLNVLSLSHSNFNGMPHNVDEPTPQTSVQFMDKMMDPLLSEADITIVTDNIVRTVFHKLYSAAMTERNVRENRYKTITFSANVSSHEHTYKGKSSVTALDENPCTFQSRFSVADKETKVNLAEDIVQAILTNLETFATSKVKSLFYSQVNFTVPVALPIQQDHSTLSKALSAKDSYSDEQFSCCSVDHTKSGKTNLCQLSLSKLNTYALQVARRNLQGIKQELDKERENPFLTHDIGISESIASQIVNALLDIISRKGKCDKNSSDKEIDLDQQKGVIEKLLNETKYRKVLQLQIQDTIEGILCDIYEKTLFQNNLSFATPTLKCSIADKHSEENSEMFMEGANKIIPKLSVPKSDVILISNDIVNIVLHNLSSAATLVINAKNPTSARLPLTFCDTFPKIDCQQPLKGSKTERKTERFSYSRNQKSAYADDNQITVVEKEDTQKSATDSCEENANFITKTIFKRLESFATERIDSLITLAFQSKEKSFVIPELENCKQNDSIFYDSSQVESDVNVLKISATETILSQELTDFTFVGRREKLGSTIHLSQARLKTYADVIASAILKLIKNDLDLEIQKIYPYQNNILFQENIIVSEIVDSMLKMLDDKRSVKEICFNSKENSNFSQLALSNEILLGHKEKERSTKQSLFTKYPLEQNQMILENKRQIIVLEEIFMRNGESKNKEKGELLIAVEELLNKLYQRVREVTGHLPPLNETANFISNSKIKTSDTTQKNSFQSHINSVANDIVESVLGKMYLVVVTSLYENNKSRTEVEISDHNDSLLMKPLRFRETKQAGKISNSPRYAISQAYSYVDSQNISVMENTLLPYLPLQVKKDLIQMVLNKITNFVSLPLKVSPKDNPKPCFKAHLKTRSKITTLPKFTKKTHLGLSAAKAKSKTKLGPGEKTLKDSRSKTAIGLSHIMSAGDAKNLLDTKLPTSELKIYAKDIIINILETIVKEFGKVKQTKALPSDQIIAAGKIVNTVLQELYVTNNCNLAYPMKSSHLRLSQGNIGTGSLPKQQACFYLENVSSQLEHIFPREGIFKKLFDKWQTESNDKENEKCKLLMIAENVLTEISIKAKELEYSLSLLNLPPLENCESRFYNHFKGASTRAEDTKAQINMFGREIVEMLLEKLQLCFLSQIPTPDSEETLSNSKEHITAKSKYGFPNKHSLSSLPIYNTKTKDQISVGSSNQIVQEIVETVLNMLESFVDLQFKHISKYEFSEIVKMPIENLSSIQQKLLNKKMLPKLQPLKMFSDKSESNTINFKENIQNILLRVHSFHSQLLTYAVNIISDMLAVIKNKLDNEISQMEPSSISILKENIVASEIIGTLMDQCTYFNESLIQNLSRESLFQGAENAYTVNQVELATNMKMFTSKLKEGSLGINPSQVSKTGFVFCSDEDMKEKYRVSSDLPTSVRSSVEDTVKNSEPTKRPDSETMPSCSTRNKVQDHRPRESNFGSFDQTMKGNSYLPEGSFLQKLLRKASDSTEAALKQVLSFIEMGKGENLRVFHYENLKPVVEPNQIQTTISPLKICLAAENIVNTVLSSCGFPSQPHTNENREIMKPFFISKQSSLSEVSGGQKDNEKSLLRMQDKKINYIPEEENENLEASREDSSFLQKLKKKEYPKIETVKEVEAFTFADHEMGSNEVHLIARHVTTSVVTYLKNFETTGKC

SEQ ID NO: 10391 - protein, 6996 aa, Artificial Sequence
  Description of Artificial Sequence: Synthetic coding sequence
MKFQLWSSQIRPLGPIFPALRALYALARAAPQEATALLGPLPLEAWNAGGGAEVVGLWPFLVRSGQRDNGVLEKESGAGEEGAEGAVPAMELYLGACSKPAKVAVTKTVASVLAADTQQCRDGVHKTHFAGVGPAQLLDLPLGVKLPVIPGSNAVFYTTNFGEKLFRPSYGFNLTDPYCRLLENQYKSLHDPHLKAYYKRKDILKRLKKGGYITSNNKVVCTLRELNKYRQYLTSLKLDFERNYIKEQRILAKQLHNIPENNQIPQHCDVAQVQNWLLKEGTESIKDQERLMRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHASPKNKKKTSEDIMLVYPAGDQNTYKETHGHTANAAHQRQNSSNNFTKKNSASVVYQADVQDNGINQKRDGMVSKNSSIFDDRGGINISGQGSIISAQVSPTRNFSRVSQAFLDPSKEEKETNADWDGRPTKRSSYLCESGPQAHATDPGIFSSPVYTNMQQNLLQNCLQEKVTSEELNIIIQNVMTWVVATVTSILYPAITKYEKRLQNNTYPVSDDSILSSDSSSFCSTCSEDFTYRSYTSATTKTFQAEPCAFVVDTSVRRPTTPIKPPPAHVEKTVVGKTCHIKGQSIISKHKYNKTNLLYSYPKLRSCKSDSHLLASFETGTKKSKDATTETDSLGSSLHCDKTAKAMDEMKNLKNVFVNFKCYLKGETEVILESILREIMSDLTQAIPSLSSVTAEVFVEQCEREKEILLSNAHIPSVASEIVENMLEKLESAVEKKCVEMFSQDLSVDIKPSLAASDELLTSSNGKPLKNSMPHTLDPMCDIAEDMVHAILEKLMTLVSFKQNEFLHLKDTNKLSCQQHKTDPICMFLQRAGKNKSSLESDEASLIVNEEVQNLISNIFSQSSLVAYIEEAINAILGYIQTELNNERIIASEETVVLLQLLEDILFQLHQEPVNESFQKSRQPRISSPSDTKEKYRLTGTRLSNSPRSGRPFPPINVPGMVLYSDDENEEIDNIVKNVLDSTFKDEKVKSQEQIPNHWFTKGNTCFECKRNIKPPTKPGSRSKAAFHDWELKTEPPSTNHEDILKKKLSSNKDISTFSQDQKHQIEKASENIVTSILKEMLKDISSVPFGHLDSKTGSEASVLVSEKPQGLSHQEWIDQMFSVSEISTVAQEITDSVLNILHKASNYISNTTKSSISSSVHQISLHNSDTEHIVKEAPNKYPLKTWFDSEKKMKYLSLFDVDPEKPPWLKSGKSEPKPVDDINDKIIRTIFKRLKSFICPKLHMGFKSSLRSQLSKYTAKIVNIVLCAIQNELELHKENLNLREIDHTKSLTDKGFFANTDKKLESLVTSIDDDILASPLLTCIYDMLLSSENAHQRSISLSSRKPKSATDSVDVQSILPNRQDKKSFHKYLATPCTHHSVNGGNHIKENAKLQVLERIGETLHEMLSKLLGTHLHSQLSCSQQSREMTNKNQKMAAALQSNIQLISKAILDYILAKLCGVDMDTSFASCGLKAISESLDIDNPSFASIIEKMAKSTKIISSIVSRRVQEDNKEETKSKAKPVAPVSSKTPSTKEMHPNKLKAVASDILNMVFAKLEGFANGHLEILGAINDGNKKSNKIGWEYESTNISRDTHEASFLSALYMHAKKVSSAILKVIQTELNVTSSDLKTSVENPPPETQILKYVVKLILDAVSSDMFNEMESEGGGIETYRYRPTYGSLPGGAESDSFLEDDAYTAKKIIDERSPQREEVKTRSLKQWALEKTLNKIEVKLKEPHISPIAPIIRNILNEIFQSTLINQLNVLSLSHSNFNGMPHNVDEPTPQTSVQFMDKMMDPLLSEADITIVTDNIVRTVFHKLYSAAMTERNVRENRYKTITFSANVSSHEHTYKGKSSVTALDENPCTFQSRFSVADKETKVNLAEDIVQAILTNLETFATSKVKSLFYSQVNFTVPVALPIQQDHSTLSKALSAKDSYSDEQFSCCSVDHTKSGKTNLCQLSLSKLNTYALQVARRNLQGIKQELDKERENPFLTHDIGISESIASQIVNALLDIISRKGKCDKNSSDKEIDLDQQKGVIEKLLNETKYRKVLQLQIQDTIEGILCDIYEKTLFQNNLSFATPTLKCSIADKHSEENSEMFMEGANKIIPKLSVPKSDVILISNDIVNIVLHNLSSAATLVINAKNPTSARLPLTFCDTFPKIDCQQPLKGSKTERKTERFSYSRNQKSAYADDNQITVVEKEDTQKSATDSCEENANFITKTIFKRLESFATERIDSLITLAFQSKEKSFVIPELENCKQNDSIFYDSSQVESDVNVLKISATETILSQELTDFTFVGRREKLGSTIHLSQARLKTYADVIASAILKLIKNDLDLEIQKIYPYQNNILFQENIIVSEIVDSMLKMLDDKRSVKEICFNSKENSNFSQLALSNEILLGHKEKERSTKQSLFTKYPLEQNQMILENKRQIIVLEEIFMRNGESKNKEKGELLIAVEELLNKLYQRVREVTGHLPPLNETANFISNSKIKTSDTTQKNSFQSHINSVANDIVESVLGKMYLVVVTSLYENNKSRTEVEISDHNDSLLMKPLRFRETKQAGKISNSPRYAISQAYSYVDSQNISVMENTLLPYLPLQVKKDLIQMVLNKITNFVSLPLKVSPKDNPKPCFKAHLKTRSKITTLPKFTKKTHLGLSAAKAKSKTKLGPGEKTLKDSRSKTAIGLSHIMSAGDAKNLLDTKLPTSELKIYAKDIIINILETIVKEFGKVKQTKALPSDQIIAAGKIVNTVLQELYVTNNCNLAYPMKSSHLRLSQGNIGTGSLPKQQACFYLENVSSQLEHIFPREGIFKKLFDKWQTESNDKENEKCKLLMIAENVLTEISIKAKELEYSLSLLNLPPLENCESRFYNHFKGASTRAEDTKAQINMFGREIVEMLLEKLQLCFLSQIPTPDSEETLSNSKEHITAKSKYGFPNKHSLSSLPIYNTKTKDQISVGSSNQIVQEIVETVLNMLESFVDLQFKHISKYEFSEIVKMPIENLSSIQQKLLNKKMLPKLQPLKMFSDKSESNTINFKENIQNILLRVHSFHSQLLTYAVNIISDMLAVIKNKLDNEISQMEPSSISILKENIVASEIIGTLMDQCTYFNESLIQNLSRESLFQGAENAYTVNQVELATNMKMFTSKLKEGSLGINPSQVSKTGFVFCSDEDMKEKYRVSSDLPTSVRSSVEDTVKNSEPTKRPDSETMPSCSTRNKVQDHRPRESNFGSFDQTMKGNSYLPEGSFLQKLLRKASDSTEAALKQVLSFIEMGKGENLRVFHYENLKPVVEPNQIQTTISPLKICLAAENIVNTVLSSCGFPSQPHTNENREIMKPFFISKQSSLSEVSGGQKDNEKSLLRMQDKKINYIPEEENENLEASREDSSFLQKLKKKEYPKIETVKEVEAFTFADHEMGSNEVHLIARHVTTSVVTYLKNFETTVFSEEKMSVSTWSRKKYESKQFLRNIYDDSSIYQCCEHLTESVLYHLTSSISDGTKKGREKEKAWEIQEATFSKIISIHSQVFESRSISIGELALCISEIIIKILFNNKIIQADIAQKMVAIPTKYTYCPGIVSGGFDDLFQDLLVGVIHVLSKEIEVDYHFESNVRNKSFSMHRNNSVPLCNKINRQASPRDWQFSTQQIGQLFQKNKLSYLACKLNSLVGNLKTSESKEVVNKVFNIVSDLFSPDECLDTGMDSGKIQRTYFYSSNNEQPNSILTNNLQLSSKSVFLLNVVCEKLIRILLEECTSTAFPDKGSVSEETSAEECQLLKMLQSVEDGKSDYRKGGMDCECLQVDYMSDLLENVAEIDQDLLTSDSMLTIISHSLVKSLMDKLSHSIQQAPESLPFANKHLNYRTREIQSSFIKARKSELIELGQSKSSLELRSYDSNSLTVSLNNPSVVSSKIQAPFNKHCAVKSSSVSPFERQRTKEMDKVAIHNKLHQEGIYAGVYSATFLEGIISELFFNLSMSLWGKNKNITVSWLNEMNTLFVNNVVNEFNNAQVTVLRNAEERLCFPPVHTETVSKIVDSVYYDVLQQYELKVACGNNPVYDNASIAEQITNGILLEILDYKLPSCFKEHLIPHSYYPLKPEIILQKLQSNLTEFTSLPRSSSDYSTMLSHSFLEDVIRRLLSQLIPPPITCSSLGKKYLMSSDFNEMSTCIINKVMSAISKHKIWFTIYDNQYLYTGKNLQKMVDSVYCNILQMSDSLVSIQKSIVSRSPIMIDQIASFIIQEIIENHLQPFLSGEVLCHPRTPLDPVSTIVTQVLSEVIESHRPQKQSPLDIHLDSFVREIVARLLSKIFSPKHNTEIELKNMTQRIVNSINRHFNKAKIHILYDDKEQAFFSFNTDIVDELATSVYRNALKQHGLDLAVDKESEDSGIFVENITNLIVAAISDYLLHPLFSGDFSASTYSNSVAENIVQDILSNISKSTEPSQSVPLYNTLLPYTFLEDMIRVLLSKLFSSASSLVLNRDTQKDISRVNFNDIASNLVSDIRMKVSQHEIRFSKEEEETKFIYSEDDIQHLVDSVFANVVQTSGSQESAVQNITSSNDILIDRIAGFIIKHICQKHLQPFVSGKSLSSSDTYFDDERRQLFYTSVYSSTFLEDVISGVLRKIFHRVVGIVQTKSIRDSEDELFEKAEELIHLITGEFSKAQVSIIDNTEERLCLPPVERDVVKTIVDMVYSKVLQEYEMEVVPNKDFLNDTKTLAARITNIILAEIFDFQIHPDLIANLPFKSHSKLSANVLIQRVQYDISKSRFQRQASTMYTTMLSHSHLEKIVTQLTSQISPLNTSAEQSDTTKSDLSNTVIKLINEIMSIISKHEICIIKYGNKKQSMISAKDIQSMVDSIYADLSHSNIYQSITKDKKSISDIPVSKIASFIIKEIFNHHIQSFLSEDKTLLLAAVDQTYKLKAIDPKQRELSFIVNSSVFLEEVISELLCKILYAFSHNMLVTENPDRVKLKLTRIVTTLVNSIVLEFTTSEILVADNFDKNLCFSERYKEMVQKIVNSVYGKVLDQYKSLIQIHRVIQSDTICFGRKIYYLLLEEIYDYQVQSLVSGELESSSYSYPQADNIIRNVLNIITKDSHALPPYITVLPHSLLEDMVYRLLGHVFPSTHTENELKEKKFPPDDEFVEAASKLTDEIIKEISEHEIRLSMAEDNAESMQLEPIENLVDSICNNILKTSEFQAEVQKDADKKGCSFLSKLAGFIMKEIMYHHLQPFLHGEESSFSDLSDYDHVSELAKSGKEKTQPSLYSATFLEDIIIDLVHKFCSLLIITEDSKKNEMAELDIMGLALKLANSLIREFKKSDIKVLPNAEKMFSFPPIDKETVDKISNFVYEQFIEKCTSHDIQKGDESNIAIGMIAALTQKAISAFRIQPLFSGDWSSTFFSFLNPDNITQRVQHLPQNTFTQISRCAKENQLSLPDQSYKDTSSTPDCKNMMSTLEINRGTMNRKKSFKTKDTSVKKGDIQNPVLSSINAIMKSGMINLTSGLATGVTNKKEVDENKVGICTQKHSENVSKVTSTTTVKSKDTQEPNLSETFNNNEIEKKRNLIPTDKKGKDDEIYTHFSLIIDDTEYEKEVLGSDSEIGYKKKIDNARESSFKKDDKLFQLSSLKSKRNLGTTTDTLEIRIRTSSNEGRRDSPTQTCRDEEHHSDYEHVQNVIENIFEDVLELSSSPEPAYYSKLSYDQSPPGDNVLNVIQEISRDSAQSVTTKKVSSSTNKNISAKEKEEEEREKEKVREEIKSEPSKPDDPQNQRESKPGIFPAKFLEDVITEMVKQLIFSSIPETQIQDRCQNVSDKQNQAKLYDTAMKLINSLLKEFSDAQIKVFRPDKGNQFPGGKVSSVPKVPPRYKEPTTDEAPSSIKIKSADKMPPMHKMMRKPSSDKIPSIDKTLVNKVVHSSVCNILNDYGSQDSIWKNINSNGENLARRLTSAVINEIFQRQVNLIFCDEVSVSACLPLESKDVVKKVQKLAQTASKECQTSSPYTIILPHKFLENVISALFSKIFSTISSTKTKEPEDNLSTELNFLQMKLVSAVATEISQDKYMTIQYVETLQSDDDEIIQLVVQSVYNNLLPQFGSQEIIQNCVTSGCKILSENIVDLVLREVASNQLQSYFCGELTPHQCVEVENIVEKILKDVFQTTDVPLPKPSHADKLSYNIIEEIAVKFLSKLLSIFPKVHKERTKSLETDMQKITSKVLNSVQEFISKSKIKLVPPTKESPTVPVADNATIENIVNSIYTSVLKHSGSYTSVFKDLMGKSNVLSDTIGFLMVNAISNSEFQPQVEEEVSNSELVLEAVKIMEKVIKIIDELKSKEKSSSRKGLTLDAKLLEEVLALFLAKLIRLPSSSSKDEKNLSKTELNKIASQLSKLVTAEISRSSISLIASDPEEHCLNPENTERIYQVVDSVYSNILQQSGTNKEFYYDIKDTNTAFPKKVASLIIDGVSSFPLDTINSTISNADLSGELDVNRIVQKAQEHAFNVIPELEQEKLDQNLSEEESPIKIVPHVGKKPVKIDPKIISEHLAVISIKTQPLEKLKQECLKRTGHSIAELRRASISGRNYSLGSPDLEKRKTERRTSLDKTGRLDVKPLEAVARNSFQNIRKPDITKVELLKDVQSKNDLIVRLVAHDIDQVYLENYIKEERDSDEDEVVLTQTFAKEEGIKVFEDQVKEVKKPIQSKLSPKSTLSTSSLKKFLSLSKCCQTTASANIESTEAISNQVIESKETHVKRAVAELDMATPKTMPETASSSWEEKPQCKKEEKNLVTEPTHYFIHRIMSSSSYNQEDLISSTGEAEDCHSDPSAKILEESSQEQKPEHGNSVKFITIFERSKDVLGSANPSKEVISETPKPDVSKQGSKMLTKMSSTLSKVFSQCNTNISRSSSPAHQDEH

SEQ ID NO: 10392 - protein, 6907 aa, Artificial Sequence
  Description of Artificial Sequence: Synthetic coding sequence
MELYLGACSKPAKVAVTKTVASVLAADTQQCRDGVHKTHFAGVGPAQLLDLPLGVKLPVIPGSNAVFYTTNFGEKLFRPSYGFNLTDPYCRLLENQYKSLHDPHLKAYYKRKDILKRLKKGGYITSNNKVVCTLRELNKYRQYLTSLKLDFERNYIKEQRILAKQLHNIPENNQIPQHCDVAQVQNWLLKEGTESIKDQERLMRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHASPKNKKKTSEDIMLVYPAGDQNTYKETHGHTANAAHQRQNSSNNFTKKNSASVVYQADVQDNGINQKRDGMVSKNSSIFDDRGGINISGQGSIISAQVSPTRNFSRVSQAFLDPSKEEKETNADWDGRPTKRSSYLCESGPQAHATDPGIFSSPVYTNMQQNLLQNCLQEKVTSEELNIIIQNVMTWVVATVTSILYPAITKYEKRLQNNTYPVSDDSILSSDSSSFCSTCSEDFTYRSYTSATTKTFQAEPCAFVVDTSVRRPTTPIKPPPAHVEKTVVGKTCHIKGQSIISKHKYNKTNLLYSYPKLRSCKSDSHLLASFETGTKKSKDATTETDSLGSSLHCDKTAKAMDEMKNLKNVFVNFKCYLKGETEVILESILREIMSDLTQAIPSLSSVTAEVFVEQCEREKEILLSNAHIPSVASEIVENMLEKLESAVEKKCVEMFSQDLSVDIKPSLAASDELLTSSNGKPLKNSMPHTLDPMCDIAEDMVHAILEKLMTLVSFKQNEFLHLKDTNKLSCQQHKTDPICMFLQRAGKNKSSLESDEASLIVNEEVQNLISNIFSQSSLVAYIEEAINAILGYIQTELNNERIIASEETVVLLQLLEDILFQLHQEPVNESFQKSRQPRISSPSDTKEKYRLTGTRLSNSPRSGRPFPPINVPGMVLYSDDENEEIDNIVKNVLDSTFKDEKVKSQEQIPNHWFTKGNTCFECKRNIKPPTKPGSRSKAAFHDWELKTEPPSTNHEDILKKKLSSNKDISTFSQDQKHQIEKASENIVTSILKEMLKDISSVPFGHLDSKTGSEASVLVSEKPQGLSHQEWIDQMFSVSEISTVAQEITDSVLNILHKASNYISNTTKSSISSSVHQISLHNSDTEHIVKEAPNKYPLKTWFDSEKKMKYLSLFDVDPEKPPWLKSGKSEPKPVDDINDKIIRTIFKRLKSFICPKLHMGFKSSLRSQLSKYTAKIVNIVLCAIQNELELHKENLNLREIDHTKSLTDKGFFANTDKKLESLVTSIDDDILASPLLTCIYDMLLSSENAHQRSISLSSRKPKSATDSVDVQSILPNRQDKKSFHKYLATPCTHHSVNGGNHIKENAKLQVLERIGETLHEMLSKLLGTHLHSQLSCSQQSREMTNKNQKMAAALQSNIQLISKAILDYILAKLCGVDMDTSFASCGLKAISESLDIDNPSFASIIEKMAKSTKIISSIVSRRVQEDNKEETKSKAKPVAPVSSKTPSTKEMHPNKLKAVASDILNMVFAKLEGFANGHLEILGAINDGNKKSNKIGWEYESTNISRDTHEASFLSALYMHAKKVSSAILKVIQTELNVTSSDLKTSVENPPPETQILKYVVKLILDAVSSDMFNEMESEGGGIETYRYRPTYGSLPGGAESDSFLEDDAYTAKKIIDERSPQREEVKTRSLKQWALEKTLNKIEVKLKEPHISPIAPIIRNILNEIFQSTLINQLNVLSLSHSNFNGMPHNVDEPTPQTSVQFMDKMMDPLLSEADITIVTDNIVRTVFHKLYSAAMTERNVRENRYKTITFSANVSSHEHTYKGKSSVTALDENPCTFQSRFSVADKETKVNLAEDIVQAILTNLETFATSKVKSLFYSQVNFTVPVALPIQQDHSTLSKALSAKDSYSDEQFSCCSVDHTKSGKTNLCQLSLSKLNTYALQVARRNLQGIKQELDKERENPFLTHDIGISESIASQIVNALLDIISRKGKCDKNSSDKEIDLDQQKGVIEKLLNETKYRKVLQLQIQDTIEGILCDIYEKTLFQNNLSFATPTLKCSIADKHSEENSEMFMEGANKIIPKLSVPKSDVILISNDIVNIVLHNLSSAATLVINAKNPTSARLPLTFCDTFPKIDCQQPLKGSKTERKTERFSYSRNQKSAYADDNQITVVEKEDTQKSATDSCEENANFITKTIFKRLESFATERIDSLITLAFQSKEKSFVIPELENCKQNDSIFYDSSQVESDVNVLKISATETILSQELTDFTFVGRREKLGSTIHLSQARLKTYADVIASAILKLIKNDLDLEIQKIYPYQNNILFQENIIVSEIVDSMLKMLDDKRSVKEICFNSKENSNFSQLALSNEILLGHKEKERSTKQSLFTKYPLEQNQMILENKRQIIVLEEIFMRNGESKNKEKGELLIAVEELLNKLYQRVREVTGHLPPLNETANFISNSKIKTSDTTQKNSFQSHINSVANDIVESVLGKMYLVVVTSLYENNKSRTEVEISDHNDSLLMKPLRFRETKQAGKISNSPRYAISQAYSYVDSQNISVMENTLLPYLPLQVKKDLIQMVLNKITNFVSLPLKVSPKDNPKPCFKAHLKTRSKITTLPKFTKKTHLGLSAAKAKSKTKLGPGEKTLKDSRSKTAIGLSHIMSAGDAKNLLDTKLPTSELKIYAKDIIINILETIVKEFGKVKQTKALPSDQIIAAGKIVNTVLQELYVTNNCNLAYPMKSSHLRLSQGNIGTGSLPKQQACFYLENVSSQLEHIFPREGIFKKLFDKWQTESNDKENEKCKLLMIAENVLTEISIKAKELEYSLSLLNLPPLENCESRFYNHFKGASTRAEDTKAQINMFGREIVEMLLEKLQLCFLSQIPTPDSEETLSNSKEHITAKSKYGFPNKHSLSSLPIYNTKTKDQISVGSSNQIVQEIVETVLNMLESFVDLQFKHISKYEFSEIVKMPIENLSSIQQKLLNKKMLPKLQPLKMFSDKSESNTINFKENIQNILLRVHSFHSQLLTYAVNIISDMLAVIKNKLDNEISQMEPSSISILKENIVASEIIGTLMDQCTYFNESLIQNLSRESLFQGAENAYTVNQVELATNMKMFTSKLKEGSLGINPSQVSKTGFVFCSDEDMKEKYRVSSDLPTSVRSSVEDTVKNSEPTKRPDSETMPSCSTRNKVQDHRPRESNFGSFDQTMKGNSYLPEGSFLQKLLRKASDSTEAALKQVLSFIEMGKGENLRVFHYENLKPVVEPNQIQTTISPLKICLAAENIVNTVLSSCGFPSQPHTNENREIMKPFFISKQSSLSEVSGGQKDNEKSLLRMQDKKINYIPEEENENLEASREDSSFLQKLKKKEYPKIETVKEVEAFTFADHEMGSNEVHLIARHVTTSVVTYLKNFETTVFSEEKMSVSTWSRKKYESKQFLRNIYDDSSIYQCCEHLTESVLYHLTSSISDGTKKGREKEKAWEIQEATFSKIISIHSQVFESRSISIGELALCISEIIIKILFNNKIIQADIAQKMVAIPTKYTYCPGIVSGGFDDLFQDLLVGVIHVLSKEIEVDYHFESNVRNKSFSMHRNNSVPLCNKINRQASPRDWQFSTQQIGQLFQKNKLSYLACKLNSLVGNLKTSESKEVVNKVFNIVSDLFSPDECLDTGMDSGKIQRTYFYSSNNEQPNSILTNNLQLSSKSVFLLNVVCEKLIRILLEECTSTAFPDKGSVSEETSAEECQLLKMLQSVEDGKSDYRKGGMDCECLQVDYMSDLLENVAEIDQDLLTSDSMLTIISHSLVKSLMDKLSHSIQQAPESLPFANKHLNYRTREIQSSFIKARKSELIELGQSKSSLELRSYDSNSLTVSLNNPSVVSSKIQAPFNKHCAVKSSSVSPFERQRTKEMDKVAIHNKLHQEGIYAGVYSATFLEGIISELFFNLSMSLWGKNKNITVSWLNEMNTLFVNNVVNEFNNAQVTVLRNAEERLCFPPVHTETVSKIVDSVYYDVLQQYELKVACGNNPVYDNASIAEQITNGILLEILDYKLPSCFKEHLIPHSYYPLKPEIILQKLQSNLTEFTSLPRSSSDYSTMLSHSFLEDVIRRLLSQLIPPPITCSSLGKKYLMSSDFNEMSTCIINKVMSAISKHKIWFTIYDNQYLYTGKNLQKMVDSVYCNILQMSDSLVSIQKSIVSRSPIMIDQIASFIIQEIIENHLQPFLSGEVLCHPRTPLDPVSTIVTQVLSEVIESHRPQKQSPLDIHLDSFVREIVARLLSKIFSPKHNTEIELKNMTQRIVNSINRHFNKAKIHILYDDKEQAFFSFNTDIVDELATSVYRNALKQHGLDLAVDKESEDSGIFVENITNLIVAAISDYLLHPLFSGDFSASTYSNSVAENIVQDILSNISKSTEPSQSVPLYNTLLPYTFLEDMIRVLLSKLFSSASSLVLNRDTQKDISRVNFNDIASNLVSDIRMKVSQHEIRFSKEEEETKFIYSEDDIQHLVDSVFANVVQTSGSQESAVQNITSSNDILIDRIAGFIIKHICQKHLQPFVSGKSLSSSDTYFDDERRQLFYTSVYSSTFLEDVISGVLRKIFHRVVGIVQTKSIRDSEDELFEKAEELIHLITGEFSKAQVSIIDNTEERLCLPPVERDVVKTIVDMVYSKVLQEYEMEVVPNKDFLNDTKTLAARITNIILAEIFDFQIHPDLIANLPFKSHSKLSANVLIQRVQYDISKSRFQRQASTMYTTMLSHSHLEKIVTQLTSQISPLNTSAEQSDTTKSDLSNTVIKLINEIMSIISKHEICIIKYGNKKQSMISAKDIQSMVDSIYADLSHSNIYQSITKDKKSISDIPVSKIASFIIKEIFNHHIQSFLSEDKTLLLAAVDQTYKLKAIDPKQRELSFIVNSSVFLEEVISELLCKILYAFSHNMLVTENPDRVKLKLTRIVTTLVNSIVLEFTTSEILVADNFDKNLCFSERYKEMVQKIVNSVYGKVLDQYKSLIQIHRVIQSDTICFGRKIYYLLLEEIYDYQVQSLVSGELESSSYSYPQADNIIRNVLNIITKDSHALPPYITVLPHSLLEDMVYRLLGHVFPSTHTENELKEKKFPPDDEFVEAASKLTDEIIKEISEHEIRLSMAEDNAESMQLEPIENLVDSICNNILKTSEFQAEVQKDADKKGCSFLSKLAGFIMKEIMYHHLQPFLHGEESSFSDLSDYDHVSELAKSGKEKTQPSLYSATFLEDIIIDLVHKFCSLLIITEDSKKNEMAELDIMGLALKLANSLIREFKKSDIKVLPNAEKMFSFPPIDKETVDKISNFVYEQFIEKCTSHDIQKGDESNIAIGMIAALTQKAISAFRIQPLFSGDWSSTFFSFLNPDNITQRVQHLPQNTFTQISRCAKENQLSLPDQSYKDTSSTPDCKNMMSTLEINRGTMNRKKSFKTKDTSVKKGDIQNPVLSSINAIMKSGMINLTSGLATGVTNKKEVDENKVGICTQKHSENVSKVTSTTTVKSKDTQEPNLSETFNNNEIEKKRNLIPTDKKGKDDEIYTHFSLIIDDTEYEKEVLGSDSEIGYKKKIDNARESSFKKDDKLFQLSSLKSKRNLGTTTDTLEIRIRTSSNEGRRDSPTQTCRDEEHHSDYEHVQNVIENIFEDVLELSSSPEPAYYSKLSYDQSPPGDNVLNVIQEISRDSAQSVTTKKVSSSTNKNISAKEKEEEEREKEKVREEIKSEPSKPDDPQNQRESKPGIFPAKFLEDVITEMVKQLIFSSIPETQIQDRCQNVSDKQNQAKLYDTAMKLINSLLKEFSDAQIKVFRPDKGNQFPGGKVSSVPKVPPRYKEPTTDEAPSSIKIKSADKMPPMHKMMRKPSSDKIPSIDKTLVNKVVHSSVCNILNDYGSQDSIWKNINSNGENLARRLTSAVINEIFQRQVNLIFCDEVSVSACLPLESKDVVKKVQKLAQTASKECQTSSPYTIILPHKFLENVISALFSKIFSTISSTKTKEPEDNLSTELNFLQMKLVSAVATEISQDKYMTIQYVETLQSDDDEIIQLVVQSVYNNLLPQFGSQEIIQNCVTSGCKILSENIVDLVLREVASNQLQSYFCGELTPHQCVEVENIVEKILKDVFQTTDVPLPKPSHADKLSYNIIEEIAVKFLSKLLSIFPKVHKERTKSLETDMQKITSKVLNSVQEFISKSKIKLVPPTKESPTVPVADNATIENIVNSIYTSVLKHSGSYTSVFKDLMGKSNVLSDTIGFLMVNAISNSEFQPQVEEEVSNSELVLEAVKIMEKVIKIIDELKSKEKSSSRKGLTLDAKLLEEVLALFLAKLIRLPSSSSKDEKNLSKTELNKIASQLSKLVTAEISRSSISLIASDPEEHCLNPENTERIYQVVDSVYSNILQQSGTNKEFYYDIKDTNTAFPKKVASLIIDGVSSFPLDTINSTISNADLSGELDVNRIVQKAQEHAFNVIPELEQEKLDQNLSEEESPIKIVPHVGKKPVKIDPKIISEHLAVISIKTQPLEKLKQECLKRTGHSIAELRRASISGRNYSLGSPDLEKRKTERRTSLDKTGRLDVKPLEAVARNSFQNIRKPDITKVELLKDVQSKNDLIVRLVAHDIDQVYLENYIKEERDSDEDEVVLTQTFAKEEGIKVFEDQVKEVKKPIQSKLSPKSTLSTSSLKKFLSLSKCCQTTASANIESTEAISNQVIESKETHVKRAVAELDMATPKTMPETASSSWEEKPQCKKEEKNLVTEPTHYFIHRIMSSSSYNQEDLISSTGEAEDCHSDPSAKILEESSQEQKPEHGNSVKFITIFERSKDVLGSANPSKEVISETPKPDVSKQGSKMLTKMSSTLSKVFSQCNTNISRSSSPAHQDEH

SEQ ID NO: 10393 - protein, 136 aa, Artificial Sequence
  Description of Artificial Sequence: Synthetic coding sequence
KDQERLMRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHGE

SEQ ID NO: 10394 - protein, 130 aa, Artificial Sequence
  Description of Artificial Sequence: Synthetic coding sequence
MRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHGE

SEQ ID NO: 10395 - protein, 458 aa, Artificial Sequence
  Description of Artificial Sequence: Synthetic coding sequence
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPAGKLEARAALNQALEMKRQGKREKAQKLFMHALKMDPDFVDALTEFGIFSEEDKDIIQADYLYTRALTISPYHEKALVNRDRTLPLVEEIDQRYFSIIDSKVKKVMSIPKGNSALRRVMEETYYHHIYHTVAIEGNTLTLSEIRHILETRYAVPGKSLEEQNEVIGMHAAMKYINTTLVSRIGSVTISDVLEIHRRVLGYVDPVEAGRFRTTQVLVGHHIPPHPQDVEKQMQEFVQWLNSEEAMNLHPVEFAALAHYKLVYIHPFIDGNGRTSRLLMNLILMQAGYPPITIRKEQRSDYYHVLEAANEGDVRPFIRFIAKCTETTLDTLLFATTEYSVALPEAQPNHSGFKETLPVKP

SEQ ID NO: 10396 - protein, 276 aa, Artificial Sequence
  Description of Artificial Sequence: Synthetic coding sequence
MASKPEKRVASSVFITLAPPRRDVAVAEEVRQAVCEARRGRPWEAPAPMKTPEAGLAGRPSPWTTPGRAAATVPAAPMQLFNGDICAFCHKTVSPRELAVEAMKRQYHAQCFTCRTCRRQLAGQSFYQKDGRPLCEPCYQDTLERCGKCGEVVRDHIIRALGQAFHPSCFTCVTCARCIGDESFALGSQNEVYCLDDFYRKFAPVCSICENPIIPRDGKDAFKIECMGRNFHENCYRCEDCRILLSVEPTDQGCYPLNNHLFCKPCHVKRSAAGCC

SEQ ID NO: 10397 - protein, 373 aa, Artificial Sequence
  Description of Artificial Sequence: Synthetic coding sequence
MASKPEKRVASSVFITLAPPRRDVAVAEEVRQAVCEARRGRPWEAPAPMKTPEAGLAGRPSPWTTPGRAAATVPAAPMQLFNGGCPPPPPVLDGEDVLPDLDLLPPPPPPPPVLLPSEEEAPAPMGASLIADLEQLHLSPPPPPPQAPAEGPSVQPGPLRPMEEELPPPPAEPVEKGASTDICAFCHKTVSPRELAVEAMKRQYHAQCFTCRTCRRQLAGQSFYQKDGRPLCEPCYQDTLERCGKCGEVVRDHIIRALGQAFHPSCFTCVTCARCIGDESFALGSQNEVYCLDDFYRKFAPVCSICENPIIPRDGKDAFKIECMGRNFHENCYRCEDCRILLSVEPTDQGCYPLNNHLFCKPCHVKRSAAGCC

SEQ ID NO: 10398 - protein, 373 aa, Artificial Sequence; identical to SEQ ID NO: 10397
  Description of Artificial Sequence: Synthetic coding sequence

SEQ ID NO: 10399 - protein, 276 aa, Artificial Sequence; identical to SEQ ID NO: 10396
  Description of Artificial Sequence: Synthetic coding sequence

SEQ ID NO: 10400 - protein, 17 aa, Artificial Sequence
  Description of Artificial Sequence: Synthetic coding sequence
MASKPEKRVASSVFITL

SEQ ID NO: 10401 - protein, 104 aa, Artificial Sequence
  Description of Artificial Sequence: Synthetic coding sequence
MASKPEKRVASSVFITLAPPRRDVAVAEEVRQAVCEARRGRPWEAPAPMKTPEAGLAGRPSPWTTPGRAAATVPAAPMQLFNGGCPPPPPVLDGEDVLPDLDLL

SEQ ID NO: 10402 - protein, 374 aa, Artificial Sequence
  Description of Artificial Sequence: Synthetic coding sequence
MASKPEKRVASSVFITLAPPRRDVAVAEEVRQAVCEARRGRPWEAPAPMKTPEAGLAGRPSPWTTPGRAAATVPAAPMQLFNGGCPPPPPVLDGEDVLPDLDLLPPPPPPPPVLLPSEEEAPAPMGASLIADLEQLHLSPPPPPPQAPAEGPSVQPGPLRPMEEELPPPPAEPVEKGASTDICAFCHKTVSPRELAVEAMKRQYHAQCFTCRTCRRQLAGQSFYQKDGRPLCEPCYQDTLERCGKCGEVVRDHIIRALGQAFHPSCFTCVTCARCIGDESFALGSQNEVYCLDDFYRYEKGLCTGWGAGTGRDPSRVKELSLSPGCWARVSCLLVYYKEYYRAGLGAVAHACNPSTLGGRGGWITRSGDRDHPG

SEQ ID NO: 10403 - protein, 145 aa, Artificial Sequence
  Description of Artificial Sequence: Synthetic coding sequence
MASKPEKRVASSVFITLAPPRRDVAVAEEVRQAVCEARRGRPWEAPAPMKTPEAGLAGRPSPWTTPGRAAATVPAAPMQLFNGGCPPPPPVLDGEDVLPDLDLLPPPPPPPPVLLPSEEEAPAPMGASLIADLEQLHLSPPPPPP

SEQ ID NO: 10404 - protein, 30 aa, Artificial Sequence
  Description of Artificial Sequence: Synthetic coding sequence
MASKPEKRVASSVFITLAPPRRDVAVAEEV

SEQ ID NO: 10405 - protein, 31 aa, Artificial Sequence
  Description of Artificial Sequence: Synthetic coding sequence
MASKPEKRVASSVFITLAPPRRDVAVAEEVR

SEQ ID NO: 10406 - protein, 144 aa, Artificial Sequence
  Description of Artificial Sequence: Synthetic coding sequence
MASKPEKRVASSVFITLAPPRRDVAVAEEVRQAVCEARRGRPWEAPAPMKTPEAGLAGRPSPWTTPGRAAATVPAAPMQLFNGDICAFCHKTVSPRELAVEAMKRQYHAQCFTCRTCRRQLAGQSFYQKDGRPLCEPCYQDTLE

SEQ ID NO: 10407 - protein, 34 aa, Artificial Sequence
  Description of Artificial Sequence: Synthetic coding sequence
MASKPEKRVASSVFITLAPPRRDVAVAEEVRQAV

SEQ ID NO: 10408 - protein, 78 aa, Artificial Sequence
  Description of Artificial Sequence: Synthetic coding sequence
MASKPEKRVASSVFITLAPPRRDVAVAEEVRQAVCEARRGRPWEAPAPMKTPEAGLAGRPSPWTTPGRAAATVPAAPM

SEQ ID NO: 10409 - protein, 14 aa, Artificial Sequence
  Description of Artificial Sequence: Synthetic coding sequence
MASKPEKRVASSVF

SEQ ID NO: 10410 - protein, 99 aa, Artificial Sequence
  Description of Artificial Sequence: Synthetic coding sequence
MCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 10411 - protein, 146 aa, Artificial Sequence
  Description of Artificial Sequence: Synthetic coding sequence
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPGTKDNLMRPPGMTSSSQ

SEQ ID NO: 10412 - protein, 201 aa, Artificial Sequence
  Description of Artificial Sequence: Synthetic coding sequence
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 10413 - protein, 211 aa, Artificial Sequence
  Description of Artificial Sequence: Synthetic coding sequence
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKGKIPPESTLIFNIDLLEIRNGPRSHESFQEMDLNDDWKLSKDEVKAYLKKEFEKHGAVVNESHHDALVEDIFDKEDEDKDGFISAREFTYKHDEL

SEQ ID NO: 10414 - protein, 570 aa, Artificial Sequence
  Description of Artificial Sequence: Synthetic coding sequence
MAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 10415 - protein, 338 aa, Artificial Sequence
  Description of Artificial Sequence: Synthetic coding sequence
MAGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 10416 - protein, 623 aa, Artificial Sequence
  Description of Artificial Sequence: Synthetic coding sequence
MAFRGWRPPPPPLLLLLLWVTGQAAPVAGLGSDAELQIERRFVPDECPRTVRSGDFVRYHYVGTFPDGQKFDSRYWDTAEDKADKSPCPQVRVGVNTSPSCRLKQKGVGIYWKDLQFLVRVQNHGLSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 10417 - protein, 432 aa, Artificial Sequence
  Description of Artificial Sequence: Synthetic coding sequence
MDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 10418 - protein, 662 aa, Artificial Sequence
  Description of Artificial Sequence: Synthetic coding sequence
MEGTHCTLQLHKPITELCYISFCLPKGEVRGFSYKGTVTLDRSNKGFHNCYQVREESDIISLSQEPDEHPGDIFFKQTPTKDILTELYKLTTERERLLTNLLSSDHILGITMGNQEGKLQELSVSLAPEDDCFQSAGDWQGELPVGPLNKRSTHGNKKPRRSSGRRESFGALPQKRTKRKGRGGRESAPLMGKDKICSSHSLPLSRTRPNLWVLEEKGNLLPNGALACSLQRRESCPPDIPKTPDTDLGFGSFETAFKDTGLGREVLPPDCSSTEAGGDGIRRPPSGLEHQQTGLSESHQDPEKHPEAEKDEMEKPAKRTCKQKPVSKVVAKVQDLSSQVQRVVKTHSKGKETIAIRPAAHAEFVPKADLLTLPGAEAGAHGSRRQGKERQGDRSSQSPAGETASISSVSASAEGAVNKVPLKVIESEKLDEAPEGKRLGFPVHTSVPHTRPETRNKRRAGLPLGGHKSLFLDLPHKVGPDSSQPRGDKKKPSPPAPAALGKVFNNSASQSSTHKQTSPVPSPLSPRLPSPQQHHRILRLPALPGEREAALNDSPCRKSRVFSGCVSADTLEPPSSAKVTETKGASPAFLRAGQPRLVPGETLEKSLGPGKTTAEPQHQSPPAFHWDLQQHFQEPVIRTVSISCASNLIKEEAGKGKESRSG

SEQ ID NO: 10419 - protein, 1196 aa, Artificial Sequence
  Description of Artificial Sequence: Synthetic coding sequence
MENVDNSLDGSDVSEPAKPEAGLEVAQSILSKFSMKSLFGFTSKLESVNPEEEDAVLKAFHSLDVNPTSQQDDSSNGLDPQEAGSRVSPDLGNDEKIASVETESEGSQRKEAGTSLLAQELLPLSTLKGTKDDVICVRGTLVHTTSDSDSDDGGQEPEEGSSTNGPKSPSGVLSEPSQESKENPGGFRENTVTGEMNGAELCAEDPQRIPPEMSSKLEAGNGGLQTERRPSQDQVGEEGSQDLPAVTNQNSSVGITESASSKKEVSGEKSFQLPAFFSGLRVLKKGATAEGGETITEIKPKDGDLALLKLTQPVQKSLVQAGLQTVKSEKKATDPKATPTLLEQLSLLLNIDMPKTEPKGADPESPRREEMGCNADQESQSGPGVPQTQGGEVKPKSPETALEAFKALFIRPPRKGTTADTSELEALKRKMRHEKESLRAVFERSNSKPADGPSDSKSPDHSLTEQDDRTPGRLQAVWPPPKTKDTEEKVGLKYTEAEYQAAILHLKREHKEEIENLQAQFELRAFHIRGEHAMITARLEETIENLKHELEHRWRGGCEERKDVCISTDDDCPPKTFRNVCVQTDRETFLKPCESESKTTRSNQLVPKKLNISSLSQLSPPNDHKDIHAALQPMEGMASNQQKALPPPPASIPPPPPLPSGLGSLSPAPPMPPVSAGPPLPPPPPPPPPLPPPSSAGPPPPPPPPPLPNSPAPPNPGGPPPAPPPPGLAPPPPPGLFFGLGSSSSQCPRKPAIEPSCPMKPLYWTRIQISDRSQNATPTLWDSLEEPDIRDPSEFEYLFSKDTTQQKKKPLSETYEKKNKVKKIIKLLDGKRSQTVGILISSLHLEMKDIQQAIFNVDDSVVDLETLAALYENRAQEDELVKIRKYYETSKEEELKLLDKPEQFLHELAQIPNFAERAQCIIFRSVFSEGITSLHRKVEIITRASKDLLHVKSVKDILALILAFGNYMNGGNRTRGQADGYSLEILPKLKDVKSRDNGINLVDYVVKYYLRYYDQEAGTEKSVFPLPEPQDFFLASQVKFEDLIKDLRKLKRQLEASEKQMVVVCKESPKEYLQPFKDKLEEFFQKAKKEHKMEESHLENAQKSFETTVRYFGMKPKSGEKEITPSYVFMVWYEFCSDFKTIWKRESKNISKERLKMAQESVSKLTSEKKVETKKINPTASLKERLRQKEASVTTN

SEQ ID NO: 10420 - protein, 503 aa, Artificial Sequence
  Description of Artificial Sequence: Synthetic coding sequence
MENVDNSLDGSDVSEPAKPEAGLEVAQSILSKFSMKSLFGFTSKLESVNPEEEDAVLKAFHSLDVNPTSQQDDSSNGLDPQEAGSRVSPDLGNDEKIASVETESEGSQRKEAGTSLLAQELLPLSTLKGTKDDVICVRGTLVHTTSDSDSDDGGQEPEEGSSTNGPKSPSGVLSEPSQESKENPGGFRENTVTGEMNGAELCAEDPQRIPPEMSSKLEAGNGGLQTERRPSQDQVGEEGSQDLPAVTNQNSSVGITESASSKKEVSGEKSFQLPAFFSGLRVLKKGATAEGGETITEIKPKDGDLALLKLTQPVQKSLVQAGLQTVKSEKKATDPKATPTLLEQLSLLLNIDMPKTEPKGADPESPRREEMGCNADQESQSGPGVPQTQGGEVKPKSPETALEAFKALFIRPPRKGTTADTSELEALKRKMRHEKESLRAVFERSNSKPADGPSDSKSPDHSLTEQDDRTPGRLQAVWPPPKTKDTEEKVGLKYTEAGNVKGS

SEQ ID NO: 10421 - protein, 1419 aa, Artificial Sequence
  Description of Artificial Sequence: Synthetic coding sequence
MEGTHCTLQLHKPITELCYISFCLPKGEVRGFSYKGTVTLDRSNKGFHNCYQVREESDIISLSQEPDEHPGDIFFKQTPTKDILTELYKLTTERERLLTNLLSSDHILGITMGNQEGKLQELSVSLAPEDDCFQSAGDWQGELPVGPLNKRSTHGNKKPRRSSGRRESFGALPQKRTKRKGRGGRESAPLMGKDKICSSHSLPLSRTRPNLWVLEEKGNLLPNGALACSLQRRESCPPDIPKTPDTDLGFGSFETAFKDTGLGREVLPPDCSSTEAGGDGIRRPPSGLEHQQTGLSESHQDPEKHPEAEKDEMEKPAKRTCKQKPVSKVVAKVQDLSSQVQRVVKTHSKGKETIAIRPAAHAEFVPKADLLTLPGAEAGAHGSRRQGKERQGDRSSQSPAGETASISSVSASAEGAVNKVPLKVIESEKLDEAPEGKRLGFPVHTSVPHTRPETRNKRRAGLPLGGHKSLFLDLPHKVGPDSSQPRGDKKKPSPPAPAALGKVFNNSASQSSTHKQTSPVPSPLSPRLPSPQQHHRILRLPALPGEREAALNDSPCRKSRVFSGCVSADTLEPPSSAKVTETKGASPAFLRAGQPRLVPGETLEKSLGPGKTTAEPQHQSPPGISSEGFPWDGFNEQTPKDLPNRDGGAWVLGYRAGPACPFLLHEEREKSNRSELYLDLHPDHSLTEQDDRTPGRLQAVWPPPKTKDTEEKVGLKYTEAEYQAAILHLKREHKEEIENLQAQFELRAFHIRGEHAMITARLEETIENLKHELEHRWRGGCEERKDVCISTDDDCPPKTFRNVCVQTDRETFLKPCESESKTTRSNQLVPKKLNISSLSQLSPPNDHKDIHAALQPMEGMASNQQKALPPPPASIPPPPPLPSGLGSLSPAPPMPPVSAGPPLPPPPPPPPPLPPPSSAGPPPPPPPPPLPNSPAPPNPGGPPPAPPPPGLAPPPPPGLFFGLGSSSSQCPRKPAIEPSCPMKPLYWTRIQISDRSQNATPTLWDSLEEPDIRDPSEFEYLFSKDTTQQKKKPLSETYEKKNKVKKIIKLLDGKRSQTVGILISSLHLEMKDIQQAIFNVDDSVVDLETLAALYENRAQEDELVKIRKYYETSKEEELKLLDKPEQFLHELAQIPNFAERAQCIIFRSVFSEGITSLHRKVEIITRASKDLLHVKSVKDILALILAFGNYMNGGNRTRGQADGYSLEILPKLKDVKSRDNGINLVDYVVKYYLRYYDQEAGTEKSVFPLPEPQDFFLASQVKFEDLIKDLRKLKRQLEASEKQMVVVCKESPKEYLQPFKDKLEEFFQKAKKEHKMEESHLENAQKSFETTVRYFGMKPKSGEKEITPSYVFMVWYEFCSDFKTIWKRESKNISKERLKMAQESVSKLTSEKKVETKKINPTASLKERLRQKEASVTTN

SEQ ID NO: 10422 - protein, 255 aa, Artificial Sequence
  Description of Artificial Sequence: Synthetic coding sequence
MSSHRRKAKGRNRRSHRAMRVAHLELATYELAATESNPESSHPGYEAAMADRPQPGWRESLKMRVSKPFGMLMLSIWILLFVCYYLSYYLCSGSSYFVLANGHILPNSENAHGQSLEEDSALEALLNFFFPTTCNLRENQVAKPCNELQDLSESECLRHKCCFSSSGTTSFKCFAPFRDVPKQMMQMFGLGAISLILVCLPIYCRSLFWRSEPADDLQRQDNRVVTGLKKQRRKRKRKSEMLQKAARGREEHGDE

SEQ ID NO: 10423 - protein, 300 aa, Artificial Sequence
  Description of Artificial Sequence: Synthetic coding sequence
MDLPPQLSFGLYVAAFALGFPLNVLAIRGATAHARLRLTPSLVYALNLGCSDLLLTVSLPLKAVEALASGAWPLPASLCPVFAVAHFFPLYAGGGFLAALSAGRYLGAAFPLGYQAFRRPCYSWGVCAAIWALVLCHLGLVFGLEAPGGWLDHSNTSLGINTPVNGSPVCLEAWDPASAGPARFSLSLLLFFLPLAITAFCYVGCLRALARSGLTHRRKLRAAWVAGGALLTLLLCVGPYNASNVASFLYPNLGGSWRKLGLITGAWSVVLNPLVTGYLGRGPGLKTVCAARTQGGKSQK

SEQ ID NO: 10424 - protein, 330 aa, Artificial Sequence
  Description of Artificial Sequence: Synthetic coding sequence
MLPDWKSSLILMAYIIIFLTGLPANLLALRAFVGRIRQPQPAPVHILLLSLTLADLLLLLLLPFKIIEAASNFRWYLPKVVCALTSFGFYSSIYCSTWLLAGISIERYLGVAFPVQYKLSRRPLYGVIAALVAWVMSFGHCTIVIIVQYLNTTEQVRSGNEITCYENFTDNQLDVVLPVRLELCLVLFFIPMAVTIFCYWRFVWIMLSQPLVGAQRRRRAVGLAVVTLLNFLVCFGPYNVSHLVGYHQRKSPWWRSIAVVFSSLNASLDPLLFYFSSSVVRRAFGRGLQVLRNQGSSLLGRRGKDTAEGTNEDRGVGQGEGMPSSDFTTE

SEQ ID NO: 10425 - protein, 346 aa, Artificial Sequence
  Description of Artificial Sequence: Synthetic coding sequence
MDTGPDQSYFSGNHWFVFSVYLLTFLVGLPLNLLALVVFVGKLQRRPVAVDVLLLNLTASDLLLLLFLPFRMVEAANGMHWPLPFILCPLSGFIFFTTIYLTALFLAAVSIERFLSVAHPLWYKTRPRLGQAGLVSVACWLLASAHCSVVYVIEFSGDISHSQGTNGTCYLEFRKDQLAILLPVRLEMAVVLFVVPLIITSYCYSRLVWILGRGGSHRRQRRVAGLLAATLLNFLVCFGPYNVSHVVGYICGESPAWRIYVTLLSTLNSCVDPFVYYFSSSGFQADFHELLRRLCGLWGQWQQESSMELKEQKGGEEQRADRPAERKTSEHSQGCGTGGQVACAES

SEQ ID NO: 10426 - protein, 585 aa, Artificial Sequence
  Description of Artificial Sequence: Synthetic coding sequence
MARPDPSAPPSLLLLLLAQLVGRAAAASKAPVCQEITVPMCRGIGYNLTHMPNQFNHDTQDEAGLEVHQFWPLVEIQCSPDLRFFLCSMYTPICLPDYHKPLPPCRSVCERAKAGCSPLMRQYGFAWPERMSCDRLPVLGRDAEVLCMDYNRSEATTAPPRPFPAKPTLPGPPGAPASGGECPAGGPFVCKCREPFVPILKESHPLYNKVRTGQVPNCAVPCYQPSFSADERTFATFWIGLWSVLCFISTSTTVATFLIDMERFRYPERPIIFLSACYLCVSLGFLVRLVVGHASVACSREHNHIHYETTGPALCTIVFLLVYFFGMASSIWWVILSLTWFLAAGMKWGNEAIAGYAQYFHLAAWLIPSVKSITALALSSVDGDPVAGICYVGNQNLNSLRGFVLGPLVLYLLVGTLFLLAGFVSLFRIRSVIKQGGTKTDKLEKLMIRIGIFTLLYTVPASIVVACYLYEQHYRESWEAALTCACPGHDTGQPRAKPEYWVLMLKYFMCLVVGITSGVWIWSGKTVESWRRFTSRCCCRPRRGHKSGGAMAAGDYPEASAALTGRTGPPGPAATYHKQVSLSHV

SEQ ID NO: 10427 - protein, 770 aa, Artificial Sequence
  Description of Artificial Sequence: Synthetic coding sequence
MSKCRKTPVQQLASPASFSPDILADIFELFAKNFSYGKPLNNEWQLPDPSEIFTCDHTELNAFLDLKNSLNEVKNLLSDKKLDEWHEHTAFTNKAGKIISHVRKSVNAELCTQAWCKFHEILCSFPLIPQEAFQNGKLNSLHLCEAPGAFIASLNHYLKSHRFPCHWSWVANTLNPYHEANDDLMMIMDDRLIANTLHWWYFGPDNTGDIMTLKFLTGLQNFISSMATVHLVTADGSFDCQGNPGEQEALVSSLHYCEVVTALTTLGNGGSFVLKMFTMFEHCSINLMYLLNCCFDQVHVFKPATSKAGNSEVYVVCLHYKGREAIHPLLSKMTLNFGTEMKRKALFPHHVIPDSFLKRHEECCVFFHKYQLETISENIRLFECMGKAEQEKLNNLRDCAIQYFMQKFQLKHLSRNNWLVKKSSIGCSTNTKWFGQRNKYFKTYNERKMLEALSWKDKVAKGYFNSWAEEHGVYHPGQSSILEGTASNLECHLWHILEGKKLPKVKCSPFCNGEILKTLNEAIEKSLGGAFNLDSKFRPKQQYSCSCHVFSEELIFSELCSLTECLQDEQVVVPSNQIKCLLVGFSTLRNIKMHIPLEVRLLESAELTTFSCSLLHDGDPTYQRLFLDCLLHSLRELHTGDVMILPVLSCFTRFMAGLIFVLHSCFRFITFVCPTSSDPLRTCAVLLCVGYQDLPNPVFRYLQSVNELLSTLLNSDSPQQVLQFVPMEVLLKGALLDFLWDLNAAIAKRHLHFIIQREREEIINSLQLQN

SEQ ID NO: 10428 - protein, 770 aa, Artificial Sequence; identical to SEQ ID NO: 10427
  Description of Artificial Sequence: Synthetic coding sequence

SEQ ID NO: 10429 - protein, 479 aa, Artificial Sequence
  Description of Artificial Sequence: Synthetic coding sequence
MVRIQRRKLLASCLCVTATVFLLVTLQVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALRWLVDRNQNFSSQEFWGLVFKD

SEQ ID NO: 10430 - protein, 357 aa, Artificial Sequence
  Description of Artificial Sequence: Synthetic coding sequence
MGIGQLPHYALVVPADGGDWEVRPMWSRCLFLHHQPDLPPSSHDQSIPLLWSQEESPPLAENDGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKVSKSKVGIEPAGWPS

SEQ ID NO: 10431 - protein, 521 aa, Artificial Sequence
  Description of Artificial Sequence: Synthetic coding sequence
MVRIQRRKLLASCLCVTATVFLLVTLQALDTVENLMKVTGPPQGVTDSMQCFNDQRPLSNTRSSEHIKEVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALRWLVDRNQNFSSQEFWGLVFKD

SEQ ID NO: 10432 - protein, 492 aa, Artificial Sequence
  Description of Artificial Sequence: Synthetic coding sequence
MAAGPIRVVLVLLGVLSVCAASGHGSVAEREAGGEAEWAEPWDGAVFRPPSALGAVGVTRSSGTPRPGREEAGDLPVLLWWSPGLFPHFPGDSERIECARGACVASRNRRALRDSRTRALLFYGTDFRASAAPLPRLAHQSWALLHEESPLNNFLLSHGPGIRLFNLTSTFSRHSDYPLSLQWLPGTAYLRRPVPPPMERAEWRRRGYAPLLYLQSHCDVPADRDRYVRELMRHIPVDSYGKCLQNRELPTARLQDTATATTEDPELLAFLSRYKFHLALENAICNDYMTEKLWRPMHLGAVPVYRGSPSVRDWMPNNHSVILIDDFESPQKLAEFIDFLDKNDEEYMKYLAYKQPGGITNQFLLDSLKHREWGVNDPLLPNYLNGFECFVCDYELARLDAEKAHAASPGDSPVFEPHIAQPSHMDCPVPTPGFGNVEEIPENDSWKEMWLQDYWQGLDQGEALTAMIHNNETEQTKFWDYLHEIFMKRQHL

SEQ ID NO: 10433 - protein, 476 aa, Artificial Sequence
  Description of Artificial Sequence: Synthetic coding sequence
MAAGPIRVVLVLLGVLSVCAASGHGSVAEREAGGEAEWAEPWDGAVFRPPSALGAVGVTRSSGTPRPGREEAGDLPVLLWWSPGLFPHFPGDSERIECARGACVASRNRRALRDSRTRALLFYGTDFRASAAPLPRLAHQSWALLHEESPLNNFLLSHGPGIRLFNLTSTFSRHSDYPLSLQWLPGTAYLRRPVPPPMERAEWRRRGYAPLLYLQSHCDVPADRDRYVRELMRHIPVDSYGKCLQNRELPTARLQDTATATTEDPELLAFLSRYKFHLALENAICNDYMTEKLWRPMHLGAVPVYRGSPSVRDWMPNNHSVILIDDFESPQKLAEFIDFLDKNDEEYMKYLAYKQPGGITNQFLLDSLKHREWGVNDPLLPNYLNGFECFVCDYELARLDAEKAHAASPGDSPVFEPHIAQPSHMDCPVPTPGFGNVEEIPENDSSLVQVRDHCICLRFLWPHSEKGRTHNYAAVP

SEQ ID NO: 10434 - protein, 189 aa, Artificial Sequence
  Description of Artificial Sequence: Synthetic coding sequence
METSAPRAGSQVVATTARHSAAYRADPLRVSSRDKLTEMAASSQGNFEGNFESLDLAEFAKKQPWWRKLFGQESGPSAEKYSVATQLFIGGVTGWCTGFIFQKVGKLAATAVGGGFFLLQLANHTGYIKVDWQRVEKDMKKAKEQLKIRKSNQIPTEVRSKAEEVVSFVKKNVLVTGGFFGGFLLGMAS

SEQ ID NO: 10435 - protein, 522 aa, Artificial Sequence
  Description of Artificial Sequence: Synthetic coding sequence
MALTETQPQLLSADLVLALQVLMLWEMTEANKVLKRRQHPQRSHCISSKILESYPGEKPLTKSLQRGEDPQFDQVISSMSSLSEYCLPSILRTLFDCDEQQRDYLMERRDLAIDFIFSLVLIEVLKQGSLTCLIIPYLGTLVPTLAICILWQTCMQKSLECWHKPSKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMI

SEQ ID NO: 10436 - protein, 195 aa, Artificial Sequence
  Description of Artificial Sequence: Synthetic coding sequence
MESLAQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 10437 - protein, 425 aa, Artificial Sequence
  Description of Artificial Sequence: Synthetic coding sequence
MAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGLRGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECRAQVQCVRTARIFGYLQQQERGHTLCKL

SEQ ID NO: 10438 - protein, 3013 aa, Artificial Sequence
  Description of Artificial Sequence: Synthetic coding sequence
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSEVSQRFPTTHPNGRQIMLTYLLPWLHNIELVDSRLLLPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 10439 - protein, 1282 aa, Artificial Sequence
  Description of Artificial Sequence: Synthetic coding sequence
MSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSGKPAIPHNTPQRAPDHAYLPAALAAQHRAGGQQAPPPGSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGE

SEQ ID NO: 10440 - protein, 150 aa, Artificial Sequence
  Description of Artificial Sequence: Synthetic coding sequence
MEITTACWRRSCVISFIKGLASPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKS

SEQ ID NO: 10441 - protein, 383 aa, Artificial Sequence
  Description of Artificial Sequence: Synthetic coding sequence
MTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 10442 - protein, 89 aa, Artificial Sequence
  Description of Artificial Sequence: Synthetic coding sequence
MERVTLALLLLAGLTALEANDPFANKDDPFYYDWKNLQLSGLICGGLLAIAGIAAVLSGKCKCKSSQKQHSPVPEKAIPLITPGSATTC

SEQ ID NO: 10443 - protein, 89 aa, Artificial Sequence; identical to SEQ ID NO: 10442
  Description of Artificial Sequence: Synthetic coding sequence

SEQ ID NO: 10444 - protein, 779 aa, Artificial Sequence
  Description of Artificial Sequence: Synthetic coding sequence
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLQWYKDDLCALAFKVLHDKQRGPLVFMRIYSGTIKPQLAIHNINGNCTERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 10445 - protein, 732 aa, Artificial Sequence
  Description of Artificial Sequence: Synthetic coding sequence
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 10446 - protein, 513 aa, Artificial Sequence
  Description of Artificial Sequence: Synthetic coding sequence
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLQWYKDDLCALAFKVLHDKQRGPLVFMRIYSGTIKPQLAIHNINGNCTERISRLLLPFADQHVEIPSLTAGNIALTVGLKHTATGDTIVSSKSSALAAARRAEREGEKKHRQNNEAERLLLAGVEIPEPVFFCTIEPPSLSKQPGINGLSVSTN

SEQ ID NO: 10447 - protein, 779 aa, Artificial Sequence; identical to SEQ ID NO: 10444
  Description of Artificial Sequence: Synthetic coding sequence

SEQ ID NO: 10448 - protein, 601 aa, Artificial Sequence
  Description of Artificial Sequence: Synthetic coding sequence
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLQWYKDDLCALAFKVLHDKQRGPLVFMRIYSGTIKPQLAIHNINGNCTERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQVAQRRGNIQEIQTRQDNKVVIGFVPLAEIMGYSTVLRTLTSGSATFALELSTYQAMNPQDQNTLLNRRSGLT

SEQ ID NO: 10449 - protein, 315 aa, Artificial Sequence
  Description of Artificial Sequence: Synthetic coding sequence
MASAVLSSVPTTASRFALLQVDSGSGSDSEPGKGKGRNTGKSQTLGSKSTTNEKKREKRRKKKEQQQSEANELRNLAFKKIPQKSSHAVCNAQHDLPLSNPVQKDSREENWQEWRQRDEQLTSEMFEADLEKALLLSKLEYEEHKKEYEDAENTSTQSKVMNKKDKRKNHQGKDRPLTVSLKDFHSEDHISKKTEEVVLKDGRIERLKLELERKDAEIQKLKNVITQWEAKYKEVKARNAQLLKMLQEGEMKDKAEILLQVDESQSIKNELTIQVTSLHAALEQERSKVKVLQAELAKYQGGRKGKRNSESDQCR

SEQ ID NO: 10450 - protein, 366 aa, Artificial Sequence
  Description of Artificial Sequence: Synthetic coding sequence
MASAVLSSVPTTASRFALLQVDSGSGSDSEPGKGKGRNTGKSQTLGSKSTTNEKKREKRRKKKEQQQSEANELRNLAFKKIPQKSSHAVCNAQHDLPLSNPVQKDSREENWQEWRQRDEQLTSEMFEADLEKALLLSKLEYEEHKKEYEDAENTSTQSKVMNKKDKRKNHQGKDRPLTVSLKDFHSEDHISKKTEELSSSQTLSHDGGFFNRLEDDVHKILIREKRREQLTEYNGTDNCTAHEHNQEVVLKDGRIERLKLELERKDAEIQKLKNVITQWEAKYKEVKARNAQLLKMLQEGEMKDKAEILLQVDESQSIKNELTIQVTSLHAALEQERSKVKVLQAELAKYQGGRKGKRNSESDQCR

SEQ ID NO: 10451 - protein, 126 aa, Artificial Sequence
  Description of Artificial Sequence: Synthetic coding sequence
MASAVLSSVPTTASRFALLQVDSGSGSDSEPGKGKGRNTGKSQTLGSKSTTNEKKREKRRKKKEQQQSEANELRNLAFKKIPQKSSHAVCNAQHDLPLSNPVQKDSREENWQEWRQRDEQMGSRRQ

SEQ ID NO: 10452 - protein, 54 aa, Artificial Sequence
  Description of Artificial Sequence: Synthetic coding sequence
MASAVLSSVPTTASRFALLQVDSGSGSDSEPGKGKGRNTGKSQTLGSKSTTNEK

SEQ ID NO: 10453 - protein, 1008 aa, Artificial Sequence
  Description of Artificial Sequence: Synthetic coding sequence
MDTAEDPAWLQLLQKDSSPPGPRPTAFFCPQDGSLGAGSSAMRDYCPSQQKASPAPPRHTPDQSPGMESRHRSPSGAGEGASCSDGPRGSLACPSPTCFSPQESPSKETLEAHGASISGTPEATTSGKPEPVSSVKTEPKSSDDRNPMFLEKMDFKSSKQADSTSIGKEDPGSSRKADPMFTGKAEPEILGKGDPVAPGRMDPMTVRKEDLGSLGKVDPLCSSKTYTVSPRKEDPGSLRKVDPVSSDKVDPVFPRKEEPRYSGKEHPVSSEKVAPTSAEKVDLVLSGKRDPGPSGKADPMPLESMDSASTGKTEPGLLGKLIPGSSGKNGPVSSGTGAPGSLGRLDPTCLGMADPASVGNVETVPATKEDSRFLGKMDPASSGEGRPVSGHTDTTASAKTDLTSLKNVDPMSSGKVDPVSLGKMDPMCSGKPELLSPGQAERVSVGKAGTVSPGKEDPVSSRREDPISAGSRKTSSEKVNPESSGKTNPVSSGPGDPRSLGTAGPPSAVKAEPATGGKGDPLSSEKAGLVASGKAAPTASGKAEPLAVGKEDPVSKGKADAGPSGQGDSVSIGKVVSTPGKTVPVPSGKVDPVSLGKAEAIPEGKVGSLPLEKGSPVTTTKADPRASGKAQPQSGGKAETKLPGQEGAAAPGEAGAVCLKKETPQASEKVDPGSCRKAEPLASGKGEPVSLGKADSAPSRKTESPSLGKVVPLSLEKTKPSSSSRQLDRKALGSARSPEGARGSEGRVEPKAEPVSSTEASSLGQKDLEAAGAERSPCPEAAAPPPGPRTRDNFTKAPSWEASAPPPPREDAGTQAGAQACVSVAVSPMSPQDGAGGSAFSFQAAPRAPSPPSRRDAGLQVSLGAAETRSVATGPMTPQAAAPPAFPEVRVRPGSALAAAVAPPEPAEPVRDVSWDEKGMTWEVYGAAMEVEVLGMAIQKHLERQIEEHGRQGAPAPPPAARAGPGRSGSVRTAPPDGAAKRPPGLFRALLQSVRRPRCCSRAGPTAE

SEQ ID NO: 10454 - protein, 798 aa, Artificial Sequence
  Description of Artificial Sequence: Synthetic coding sequence
MDTAEDPAWLQLLQKDSSPPGPRPTAFFCPQDGSLGAGSSAMRDYCPSQQKASPAPPRHTPDQSPGMESRHRSPSGAGEGASCSDGPRGSLACPSPTCFSPQESPSKETLEAHGASISGTPEATTSGKPEPVSSVKTEPKSSDDRNPMFLEKMDFKSSKQADSTSIGKEDPGSSRKADPMFTGKAEPEILGKGDPVAPGRMDPMTVRKEDLGSLGKVDPLCSSKTYTVSPRKEDPGSLRKVDPVSSDKVDPVFPRKEEPRYSGKEHPVSSEKVAPTSAEKVDLVLSGKRDPGPSGKADPMPLESMDSASTGKTEPGLLGKLIPGSSGKNGPVSSGTGAPGSLGRLDPTCLGMADPASVGNVETVPATKEDSRFLGKMDPASSGEGRPVSGHTDTTASAKTDLTSLKNVDPMSSGKVDPVSLGKMDPMCSGKPELLSPGQAERVSVGKAGTVSPGKEDPVSSRREDPISAGSRKTSSEKVNPESSGKTNPVSSGPGDPRSLGTAGPPSAVKAEPATGGKGDPLSSEKAGLVASGKAAPTASGKAEPLAVGKEDPVSKGKADAGPSGQGDSVSIGKVVSTPGKTVPVPSGKVDPVSLGKAEAIPEGKVGSLPLEKGSPVTTTKADPRASGKAQPQSGGKAETKLPGQEGAAAPGEAGAVCLKKETPQASEKVDPGSCRKAEPLASGKGEPVSLGKADSAPSRKTESPSLGKVVPLSLEKTKPSSSSRQLDRKALGSARSPEGARGSEGRQASARPVPRAAAECAPAAVLLAGGTHGRVICPHFVRPSFRPSQAPFLITGP

SEQ ID NO: 10455 - protein, 552 aa, Artificial Sequence
  Description of Artificial Sequence: Synthetic coding sequence
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 10456 - protein, 600 aa, Artificial Sequence
  Description of Artificial Sequence: Synthetic coding sequence
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIESHHFAQADLELLASSCPPASVSQRAGITAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 10457 - protein, 571 aa, Artificial Sequence
  Description of Artificial Sequence: Synthetic coding sequence
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 10458 - protein, 379 aa, Artificial Sequence
  Description of Artificial Sequence: Synthetic coding sequence
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVL

SEQ ID NO: 10459 - protein, 543 aa, Artificial Sequence
  Description of Artificial Sequence: Synthetic coding sequence
MAVSERRGLGRGSPAEWGQRLLLVLLLGGCSGRIHQLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 10460 - protein, 301 aa, Artificial Sequence
  Description of Artificial Sequence: Synthetic coding sequence
MIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 10461 - protein, 713 aa, Artificial Sequence
  Description of Artificial Sequence: Synthetic coding sequence
MDISIQRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 10462 - protein, 218 aa, Artificial Sequence
  Description of Artificial Sequence: Synthetic coding sequence
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRMSLLSPKLECNGTI

SEQ ID NO: 10463 - protein, 629 aa, Artificial Sequence
  Description of Artificial Sequence: Synthetic coding sequence
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRQRKKKQ

SEQ ID NO: 10464 - protein, 910 aa, Artificial Sequence
  Description of Artificial Sequence: Synthetic coding sequence
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 10465 - protein, 708 aa, Artificial Sequence
  Description of Artificial Sequence: Synthetic coding sequence
MGLTAYGNRRVQPGELPFGANLTLIHTRAQPVICSKLLLTKRVSPISFFLSKFQNSWGEDGWVQLDQLPSPNAVSSDQVHCSAGCTHRKCGWAASKSKEKVPARPHGVCDGVCTDYSQCTQPCPPDTQGNMGFSCRQKTWHKITDTCQTLNALNIFEEDSRLVQPFEDNIKISVYTGKSETITDMLLQKCPTDLSCVIRNIQQSPWIPGNIAVIVQLLHNISTAIWTGVDEAKMQSYSTIANHILNSKSISNWTFIPDRNSSYILLHSVNSFARRLFIDKHPVDISDVFIHTMGTTISGDNIGKNFTFSMRINDTSNEVTGRVLISRDELRKVPSPSQVISIAFPTIGAILEASLLENVTVNGLVLSAILPKELKRISLIFEKISKSEERRTQCVGWHSVENRWDQQACKMIQENSQQAVCKCRPSKLFTSFSILMSPHILESLILTYITYVGLGISICSLILCLSIEVLVWSQVTKTEITYLRHVCIVNIAATLLMADVWFIVASFLSGPITHHKGCVAATFFVHFFYLSVFFWMLAKALLILYGIMIVFHTLPKSVLVASLFSVGYGCPLAIAAITVAATEPGKGYLRPEICWLNWDMTKALLAFVIPALAIVVVNLITVTLVIVKTQRAAIGNSMFQEVRAIVRISKNIAILTPLLGLTWGFGVATVIDDRSLAFHIIFSLLNAFQVSPDASDQVQSERIHEDVL

SEQ ID NO: 10466 - protein, 642 aa, Artificial Sequence
  Description of Artificial Sequence: Synthetic coding sequence
MTHILLLYYLVFLLPTESCRTLYQAASKSKEKVPARPHGVCDGVCTDYSQCTQPCPPDTQGNMGFSCRQKTWHKITDTCQTLNALNIFEEDSRLVQPFEDNIKISVYTGKSETITDMLLQKCPTDLSCVIRNIQQSPWIPGNIAVIVQLLHNISTAIWTGVDEAKMQSYSTIANHILNSKSISNWTFIPDRNSSYILLHSVNSFARRLFIDKHPVDISDVFIHTMGTTISGDNIGKNFTFSMRINDTSNEVTGRVLISRDELRKVPSPSQVISIAFPTIGAILEASLLENVTVNGLVLSAILPKELKRISLIFEKISKSEERRTQCVGWHSVENRWDQQACKMIQENSQQAVCKCRPSKLFTSFSILMSPHILESLILTYITYVGLGISICSLILCLSIEVLVWSQVTKTEITYLRHVCIVNIAATLLMADVWFIVASFLSGPITHHKGCVAATFFVHFFYLSVFFWMLAKALLILYGIMIVFHTLPKSVLVASLFSVGYGCPLAIAAITVAATEPGKGYLRPEICWLNWDMTKALLAFVIPALAIVVVNLITVTLVIVKTQRAAIGNSMFQEVRAIVRISKNIAILTPLLGLTWGFGVATVIDDRSLAFHIIFSLLNAFQGFFILVFGTILDPKIREALKG

SEQ ID NO: 10467 - protein, 642 aa, Artificial Sequence; identical to SEQ ID NO: 10466
  Description of Artificial Sequence: Synthetic coding sequence

SEQ ID NO: 10468 - protein, 2804 aa, Artificial Sequence
  Description of Artificial Sequence: Synthetic coding sequence
MDDNSRYWMAFSYITNNALLGREDIDLGLAGDHQQLILYRLGKTFSIRHHLASFQWHTICLIWDGVKGKLELFLNKERILEVTDQPHNLTPHGTLFLGHFLKNESSEVKSMMRSFPGSLYYFQLWDHILENEEFMKCLDGNIVSWEEDVWLVNKIIPTVDRTLRCFVPENMTIQEKSTTVSQQIDMTTPSQITGVKPQNTAHSSTLLSQSIPIFATDYTTISYSNTTSPPLETMTAQKILKTLVDETATFAVDVLSTSSAISLPTQSISIDNTTNSMKKTKSPSSESTKTTKMVEAMATEIFQPPTPSNFLSTSRFTKNSVVSTTSAIKSQSAVTKTTSLFSTIESTSMSTTPCLKQKSTNTGALPISTAGQEFIESTAAGTVPWFTVEKTSPASTHVGTASSFPPEPVLISTAAPVDSVFPRNQTAFPLATTDMKIAFTVHSLTLPTRLIETTPAPRTAETELTSTNFQDVSLPRVEDAMSTSMSKETSSKTFSFLTSFSFTGTESVQTVIDAEATRTALTPEITLASTVAETMLSSTITGRVYTQNTPTADGHLLTLMSTRSASTSKAPESGPTSTTDEAAHLFSSNETIWTSRPDQALLASMNTTTILTFVPNENFTSAFHENTTYTEYLSATTNITPLKASPEGKGTTANDATTARYTTAVSKLTSPWFANFSIVSGTTSITNMPEFKLTTLLLKTIPMSTKPANELPLTPRETVVPSVDIISTLACIQPNFSTEESASETTQTEINGAIVFGGTTTPVPKSATTQRLNATVTRKEATSHYLMRKSTIAAVAEVSPFSTMLEVTDESAQRVTASVTVSSFPDIEKLSTPLDNKTATTEVRESWLLTKLVKTTPRSSYNEMTEMFNFNHTYVAHWTSETSEGISAGSPTSGSTHIFGEPLGASTTRISETSFSTTPTDRTATSLSDGILPPQPTAAHSSATPVPVTHMFSLPVNGSSVVAEETEVTMSEPSTLARAFSTSVLSDVSNLSSTTMTTALVPPLDQTASTTIVIVPTHGDLIRTTSEATVISVRKTSMAVPSLTETPFHSLRLSTPVTAKAETTLFSTSVDTVTPSTHTLVCSKPPPDNIPPASSTHVISTTSTPEATQPISQVEETSTYALSFPYTFSGGGVVASLATGTTETSVVDETTPSHISANKLTTSVNSHISSSATYRVHTPVSIQLVTSTSVLSSDKDQMTISLGKTPRTMEVTEMSPSKNSFISYSRGTPSLEMTDTGFPETTKISSHQTHSPSEIPLGTPSDGNLASSPTSGSTQITPTLTSSNTVGVHIPEMSTSLGKTALPSQALTITTFLCPEKESTSALPAYTPRTVEMIVNSTYVTHSVSYGQDTSFVDTTTSSSTRISNPMDINTTFSHLHSLRTQPEVTSVASFISESTQTFPESLSLSTAGLYNDGFTVLSDRITTAFSVPNVPTMLPRESSMATSTPIYQMSSLPVNVTAFTSKKVSDTPPIVITKSSKTMHPGCLKSPCTATSGPMSEMSSIPVNNSAFTPATVSSDTSTRVGLFSTLLSSVTPRTTMTMQTSTLDVTPVIYAGATSKNKMVSSAFTTEMIEAPSRITPTTFLSPTEPTLPFVKTVPTTIMAGIVTPFVGTTAFSPLSSKSTGAISSIPKTTFSPFLSATQQSSQADEATTLGILSGITNRSLSTVNSGTGVALTDTYSRITVPENMLSPTHADSLHTSFNIQVSPSLTSFKSASGPTKNVKTTTNCFSSNTRKMTSLLEKTSLTNYATSLNTPVSYPPWTPSSATLPSLTSFVYSPHSTEAEISTPKTSPPPTSQMVEFPVLGTRMTSSNTQPLLMTSWNIPTAEGSQFPISTTINVPTSNEMETETLHLVPGPLSTFTASQTGLVSKDVMAMSSIPMSGILPNHGLSENPSLSTSLRAITSTLADVKHTFEKMTTSVTPGTTLPSILSGATSGSVISKSPILTWLLSSLPSGSPPATVSNAPHVMTSSTVEVSKSTFLTSDMISAHPFTNLTTLPSATMSTILTRTIPTPTLGGITTGFPTSLPMSINVTDDIVYISTHPEASSRTTITANPRTVSHPSSFSRKTMSPSTTDHTLSVGAMPLPSSTITSSWNRIPTASSPSTLIIPKPTLDSLLNIMTTTSTVPGASFPLISTGVTYPFTATVSSPISSFFETTWLDSTPSFLSTEASTSPTATKSTEPGNCKADETASKYKGTYKWLLTNPTETAQTRCIKNEDGNATRFCSISINTGKSQWEKPKFKQCKLLQELPDKIVDLANITISDENAEDVAEHILNLINESPALGKEETKIIVSKISDISQCDEISMNLTHVMLQIINVVLEKQNNSASDLHEISNEILRIIERTGHKMEFSGQIANLTVAGLALAVLRGDHTFDGMAFSIHSYEEGTDPETKNVTKALTTYVVSASISDDMFIQNLADPVVITLQHIGGNQNYGQVHCAFWDFENNNGLGGWNSSGCKVKETNVNYTICQCDHLTHFGVLMDLSRSTVDSVNEQILALITYTGCGISSIFLGVAVVTYIAFHKLRKDYPAKILINLCTALLMLNLVFLINSWLSSFQKVGVCITAAVALHYFLLVSFTWMGLEAVHMYLALVKVFNIYIPNYILKFCLVGWGIPAIMVAITVSVKKDLYGTLSPTTPFCWIKDDSIFYISVVAYFCLIFLMNLSMFCTVLVQLNSVKSQIQKTRRKMILHDLKGTMSLTFLLGLTWGFAFFAWGPMRNFFLYLFAIFNTLQDGSSRCQIKVGYKQEGLKKIFEHKLLTPSLKSTATSSTFKSLGSAQGTPSEISFPNAPELSALHVVASEPTTG

SEQ ID NO: 10469 - protein, 3080 aa, Artificial Sequence
  Description of Artificial Sequence: Synthetic coding sequence
MKEHIIYQKLYGLILMSSFIFLSDTLSLKGKKLDFFGRGDTYVSLIDTIPELSRFTACIDLVFMDDNSRYWMAFSYITNNALLGREDIDLGLAGDHQQLILYRLGKTFSIRHHLASFQWHTICLIWDGVKGKLELFLNKERILEVTDQPHNLTPHGTLFLGHFLKNESSEVKSMMRSFPGSLYYFQLWDHILENEEFMKCLDGNIVSWEEDVWLVNKIIPTVDRTLRCFVPENMTIQEKSTTVSQQIDMTTPSQITGVKPQNTAHSSTLLSQSIPIFATDYTTISYSNTTSPPLETMTAQKILKTLVDETATFAVDVLSTSSAISLPTQSISIDNTTNSMKKTKSPSSESTKTTKMVEAMATEIFQPPTPSNFLSTSRFTKNSVVSTTSAIKSQSAVTKTTSLFSTIESTSMSTTPCLKQKSTNTGALPISTAGQEFIESTAAGTVPWFTVEKTSPASTHVGTASSFPPEPVLISTAAPVDSVFPRNQTAFPLATTDMKIAFTVHSLTLPTRLIETTPAPRTAETELTSTNFQDVSLPRVEDAMSTSMSKETSSKTFSFLTSFSFTGTESVQTVIDAEATRTALTPEITLASTVAETMLSSTITGRVYTQNTPTADGHLLTLMSTRSASTSKAPESGPTSTTDEAAHLFSSNETIWTSRPDQALLASMNTTTILTFVPNENFTSAFHENTTYTEYLSATTNITPLKASPEGKGTTANDATTARYTTAVSKLTSPWFANFSIVSGTTSITNMPEFKLTTLLLKTIPMSTKPANELPLTPRETVVPSVDIISTLACIQPNFSTEESASETTQTEINGAIVFGGTTTPVPKSATTQRLNATVTRKEATSHYLMRKSTIAAVAEVSPFSTMLEVTDESAQRVTASVTVSSFPDIEKLSTPLDNKTATTEVRESWLLTKLVKTTPRSSYNEMTEMFNFNHTYVAHWTSETSEGISAGSPTSGSTHIFGEPLGASTTRISETSFSTTPTDRTATSLSDGILPPQPTAAHSSATPVPVTHMFSLPVNGSSVVAEETEVTMSEPSTLARAFSTSVLSDVSNLSSTTMTTALVPPLDQTASTTIVIVPTHGDLIRTTSEATVISVRKTSMAVPSLTETPFHSLRLSTPVTAKAETTLFSTSVDTVTPSTHTLVCSKPPPDNIPPASSTHVISTTSTPEATQPISQVEETSTYALSFPYTFSGGGVVASLATGTTETSVVDETTPSHISANKLTTSVNSHISSSATYRVHTPVSIQLVTSTSVLSSDKDQMTISLGKTPRTMEVTEMSPSKNSFISYSRGTPSLEMTDTGFPETTKISSHQTHSPSEIPLGTPSDGNLASSPTSGSTQITPTLTSSNTVGVHIPEMSTSLGKTALPSQALTITTFLCPEKESTSALPAYTPRTVEMIVNSTYVTHSVSYGQDTSFVDTTTSSSTRISNPMDINTTFSHLHSLRTQPEVTSVASFISESTQTFPESLSLSTAGLYNDGFTVLSDRITTAFSVPNVPTMLPRESSMATSTPIYQMSSLPVNVTAFTSKKVSDTPPIVITKSSKTMHPGCLKSPCTATSGPMSEMSSIPVNNSAFTPATVSSDTSTRVGLFSTLLSSVTPRTTMTMQTSTLDVTPVIYAGATSKNKMVSSAFTTEMIEAPSRITPTTFLSPTEPTLPFVKTVPTTIMAGIVTPFVGTTAFSPLSSKSTGAISSIPKTTFSPFLSATQQSSQADEATTLGILSGITNRSLSTVNSGTGVALTDTYSRITVPENMLSPTHADSLHTSFNIQVSPSLTSFKSASGPTKNVKTTTNCFSSNTRKMTSLLEKTSLTNYATSLNTPVSYPPWTPSSATLPSLTSFVYSPHSTEAEISTPKTSPPPTSQMVEFPVLGTRMTSSNTQPLLMTSWNIPTAEGSQFPISTTINVPTSNEMETETLHLVPGPLSTFTASQTGLVSKDVMAMSSIPMSGILPNHGLSENPSLSTSLRAITSTLADVKHTFEKMTTSVTPGTTLPSILSGATSGSVISKSPILTWLLSSLPSGSPPATVSNAPHVMTSSTVEVSKSTFLTSDMISAHPFTNLTTLPSATMSTILTRTIPTPTLGGITTGFPTSLPMSINVTDDIVYISTHPEASSRTTITANPRTVSHPSSFSRKTMSPSTTDHTLSVGAMPLPSSTITSSWNRIPTASSPSTLIIPKPTLDSLLNIMTTTSTVPGASFPLISTGVTYPFTATVSSPISSFFETTWLDSTPSFLSTEASTSPTATKSTVSFYNVEMSFSVFVEEPRIPITSVINEFTENSLNSIFQNSEFSLATLETQIKSRDISEEEMVMDRAILEQREGQEMATISYVPYSCVCQVIIKASSSLASSELMRKIKSKIHGNFTHGNFTQDQLTLLVNCEHVAVKKLEPGNCKADETASKYKGTYKWLLTNPTETAQTRCIKNEDGNATRFCSISINTGKSQWEKPKFKQCKLLQELPDKIVDLANITISDENAEDVAEHILNLINESPALGKEETKIIVSKISDISQCDEISMNLTHVMLQIINVVLEKQNNSASDLHEISNEILRIIERTGHKMEFSGQIANLTVAGLALAVLRGDHTFDGMAFSIHSYEEGTDPEIFLGNVPVGGILASIYLPKSLTERIPLSNLQTILFNFFGQTSLFKTKNVTKALTTYVVSASISDDMFIQNLADPVVITLQHIGGNQNYGQVHCAFWDFENNNGLGGWNSSGCKVKETNVNYTICQCDHLTHFGVLMDLSRSTVDSVNEQILALITYTGCGISSIFLGVAVVTYIAFHKLRKDYPAKILINLCTALLMLNLVFLINSWLSSFQKVGVCITAAVALHYFLLVSFTWMGLEAVHMYLALVKVFNIYIPNYILKFCLVGWGIPAIMVAITVSVKKDLYGTLSPTTPFCWIKDDSIFYISVVAYFCLIFLMNLSMFCTVLVQLNSVKSQIQKTRRKMILHDLKGTMSLTFLLGLTWGFAFFAWGPMRNFFLYLFAIFNTLQGFFIFVFHCVMKESVREQWQIHLCCGWLRLDNSSDGSSRCQIKVGYKQEGLKKIFEHKLLTPSLKSTATSSTFKSLGSAQGTPSEISFPNDDFDKDPYCSSP

SEQ ID NO: 10470 - protein, 3080 aa, Artificial Sequence; identical to SEQ ID NO: 10469
  Description of Artificial Sequence: Synthetic coding sequence

SEQ ID NO: 10471 - protein, 2875 aa, Artificial Sequence
  Description of Artificial Sequence: Synthetic coding sequence
MKEHIIYQKLYGLILMSSFIFLSVVPENMTIQEKSTTVSQQIDMTTPSQITGVKPQNTAHSSTLLSQSIPIFATDYTTISYSNTTSPPLETMTAQKILKTLVDETATFAVDVLSTSSAISLPTQSISIDNTTNSMKKTKSPSSESTKTTKMVEAMATEIFQPPTPSNFLSTSRFTKNSVVSTTSAIKSQSAVTKTTSLFSTIESTSMSTTPCLKQKSTNTGALPISTAGQEFIESTAAGTVPWFTVEKTSPASTHVGTASSFPPEPVLISTAAPVDSVFPRNQTAFPLATTDMKIAFTVHSLTLPTRLIETTPAPRTAETELTSTNFQDVSLPRVEDAMSTSMSKETSSKTFSFLTSFSFTGTESVQTVIDAEATRTALTPEITLASTVAETMLSSTITGRVYTQNTPTADGHLLTLMSTRSASTSKAPESGPTSTTDEAAHLFSSNETIWTSRPDQALLASMNTTTILTFVPNENFTSAFHENTTYTEYLSATTNITPLKASPEGKGTTANDATTARYTTAVSKLTSPWFANFSIVSGTTSITNMPEFKLTTLLLKTIPMSTKPANELPLTPRETVVPSVDIISTLACIQPNFSTEESASETTQTEINGAIVFGGTTTPVPKSATTQRLNATVTRKEATSHYLMRKSTIAAVAEVSPFSTMLEVTDESAQRVTASVTVSSFPDIEKLSTPLDNKTATTEVRESWLLTKLVKTTPRSSYNEMTEMFNFNHTYVAHWTSETSEGISAGSPTSGSTHIFGEPLGASTTRISETSFSTTPTDRTATSLSDGILPPQPTAAHSSATPVPVTHMFSLPVNGSSVVAEETEVTMSEPSTLARAFSTSVLSDVSNLSSTTMTTALVPPLDQTASTTIVIVPTHGDLIRTTSEATVISVRKTSMAVPSLTETPFHSLRLSTPVTAKAETTLFSTSVDTVTPSTHTLVCSKPPPDNIPPASSTHVISTTSTPEATQPISQVEETSTYALSFPYTFSGGGVVASLATGTTETSVVDETTPSHISANKLTTSVNSHISSSATYRVHTPVSIQLVTSTSVLSSDKDQMTISLGKTPRTMEVTEMSPSKNSFISYSRGTPSLEMTDTGFPETTKISSHQTHSPSEIPLGTPSDGNLASSPTSGSTQITPTLTSSNTVGVHIPEMSTSLGKTALPSQALTITTFLCPEKESTSALPAYTPRTVEMIVNSTYVTHSVSYGQDTSFVDTTTSSSTRISNPMDINTTFSHLHSLRTQPEVTSVASFISESTQTFPESLSLSTAGLYNDGFTVLSDRITTAFSVPNVPTMLPRESSMATSTPIYQMSSLPVNVTAFTSKKVSDTPPIVITKSSKTMHPGCLKSPCTATSGPMSEMSSIPVNNSAFTPATVSSDTSTRVGLFSTLLSSVTPRTTMTMQTSTLDVTPVIYAGATSKNKMVSSAFTTEMIEAPSRITPTTFLSPTEPTLPFVKTVPTTIMAGIVTPFVGTTAFSPLSSKSTGAISSIPKTTFSPFLSATQQSSQADEATTLGILSGITNRSLSTVNSGTGVALTDTYSRITVPENMLSPTHADSLHTSFNIQVSPSLTSFKSASGPTKNVKTTTNCFSSNTRKMTSLLEKTSLTNYATSLNTPVSYPPWTPSSATLPSLTSFVYSPHSTEAEISTPKTSPPPTSQMVEFPVLGTRMTSSNTQPLLMTSWNIPTAEGSQFPISTTINVPTSNEMETETLHLVPGPLSTFTASQTGLVSKDVMAMSSIPMSGILPNHGLSENPSLSTSLRAITSTLADVKHTFEKMTTSVTPGTTLPSILSGATSGSVISKSPILTWLLSSLPSGSPPATVSNAPHVMTSSTVEVSKSTFLTSDMISAHPFTNLTTLPSATMSTILTRTIPTPTLGGITTGFPTSLPMSINVTDDIVYISTHPEASSRTTITANPRTVSHPSSFSRKTMSPSTTDHTLSVGAMPLPSSTITSSWNRIPTASSPSTLIIPKPTLDSLLNIMTTTSTVPGASFPLISTGVTYPFTATVSSPISSFFETTWLDSTPSFLSTEASTSPTATKSTVSFYNVEMSFSVFVEEPRIPITSVINEFTENSLNSIFQNSEFSLATLETQIKSRDISEEEMVMDRAILEQREGQEMATISYVPYSCVCQVIIKASSSLASSELMRKIKSKIHGNFTHGNFTQDQLTLLVNCEHVAVKKLEPGNCKADETASKYKGTYKWLLTNPTETAQTRCIKNEDGNATRFCSISINTGKSQWEKPKFKQCKLLQELPDKIVDLANITISDENAEDVAEHILNLINESPALGKEETKIIVSKISDISQCDEISMNLTHVMLQIINVVLEKQNNSASDLHEISNEILRIIERTGHKMEFSGQIANLTVAGLALAVLRGDHTFDGMAFSIHSYEEGTDPEIFLGNVPVGGILASIYLPKSLTERIPLSNLQTILFNFFGQTSLFKTKNVTKALTTYVVSASISDDMFIQNLADPVVITLQHIGGNQNYGQVHCAFWDFENNNGLGGWNSSGCKVKETNVNYTICQCDHLTHFGVLMDLSRSTVDSVNEQILALITYTGCGISSIFLGVAVVTYIAFHKLRKDYPAKILINLCTALLMLNLVFLINSWLSSFQKVGVCITAAVALHYFLLVSFTWMGLEAVHMYLALVKVFNIYIPNYILKFCLVGWGIPAIMVAITVSVKKDLYGTLSPTTPFCWIKDDSIFYISVVAYFCLIFLMNLSMFCTVLVQLNSVKSQIQKTRRKMILHDLKGTMSLTFLLGLTWGFAFFAWGPMRNFFLYLFAIFNTLQGFFIFVFHCVMKESVREQWQIHLCCGWLRLDNSSDGSSRCQIKVGYKQEGLKKIFEHKLLTPSLKSTATSSTFKSLGSAQGTPSEISFPNDDFDKDPYCSSP

SEQ ID NO: 10472 - protein, 1079 aa, Artificial Sequence
  Description of Artificial Sequence: Synthetic coding sequence
MVCSAAPLLLLATTLPLLGSPVAQASQPVSETGVRPREGLQRRQWGPLIGRDKAWNERIDRPFPACPIPLSSSFGRWPKGQTMWAQTSTLTLTEEELGQSQAGGESGSGQLLDQENGAGESALVSVYVHLDFPDKTWPPELSRTLTLPAASASSSPRPLLTGLRLTTECNVNHKGNFYCACLSGYQWNTSICLHYPPCQSLHNHQPCGCLVFSHPEPGYCQLLPPGSPVTCLPAVPGILNLNSQLQMPGDTLSLTLHLSQEATNLSWFLRHPGSPSPILLQPGTQVSVTSSHGQAALSVSNMSHHWAGEYMSCFEAQGFKWNLYEVVRVPLKATDVARLPYQLSISCATSPGFQLSCCIPSTNLAYTAAWSPGEGSKASSFNESGSQCFVLAVQRCPMADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLVSCCLQILSCASKSMSEGIPWPSSEDMGTARS

SEQ ID NO: 10473 - protein, 873 aa, Artificial Sequence
  Description of Artificial Sequence: Synthetic coding sequence
MTTRKLSAHSAATPGYKAVTHKHHTGWARMAKTGLPEKGQSQAGGESGSGQLLDQENGAGESALVSVYVHLDFPDKTWPPELSRTLTLPAASASSSPRPLLTGLRLTTGEYMSCFEAQGFKWNLYEVVRVPLKATDVARLPYQLSISCATSPGFQLSCCIPSTNLAYTAAWSPGEGSKASSFNESGSQCFVLAVQRCPMADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLATNEGCILEHSKGGSDTARKTDASE

SEQ ID NO: 10474 - protein, 675 aa, Artificial Sequence
  Description of Artificial Sequence: Synthetic coding sequence
MADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLATNEGCILEHSKGGSDTARKTDASE

SEQ ID NO: 10475 - protein, 997 aa, Artificial Sequence
  Description of Artificial Sequence: Synthetic coding sequence
MVCSAAPLLLLATTLPLLGSPVAQASQPGQSQAGGESGSGQLLDQENGAGESALVSVYVHLDFPDKTWPPELSRTLTLPAASASSSPRPLLTGLRLTTECNVNHKGNFYCACLSGYQWNTSICLHYPPCQSLHNHQPCGCLVFSHPEPGYCQLLPPGSPVTCLPAVPGILNLNSQLQMPGDTLSLTLHLSQEATNLSWFLRHPGSPSPILLQPGTQVSVTSSHGQAALSVSNMSHHWAGEYMSCFEAQGFKWNLYEVVRVPLKATDVARLPYQLSISCATSPGFQLSCCIPSTNLAYTAAWSPGEGSKASSFNESGSQCFVLAVQRCPMADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLATNEGCILEHSKGGSDTAR

SEQ ID NO: 10476 - protein, 528 aa, Artificial Sequence
  Description of Artificial Sequence: Synthetic coding sequence
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLEGYTLTCVFWKEGARKQPWGGWSPEGCRTEQPSHSQVLCRCNHLTYFAVLMQLSPALVPAELLAPLTYISLVGCSISIVASLITVLLHFHFRKQSDSLTRIHMNLHASVLLLNIAFLLSPAFAMSPVPGSACTALAAALHYALLSCLTWMAIEGFNLYLLLGRVYNIYIRRYVFKLGVLGWGAPALLVLLSLSVKSSVYGPCTIPVFDSWENGTGFQNMSICWVRSPVVHSVLVMGYGGLTSLFNLVVLAWALWTLRRLRERADAPSVRACHDTVTVLGLTVLLGTTWALAFFSFGVFLLPQLFLFTILNSLYGFFLFLWFCSQRCRSEAEAKAQIEAFSSSQTTQ

SEQ ID NO: 10477 - protein, 570 aa, Artificial Sequence
  Description of Artificial Sequence: Synthetic coding sequence
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLEGYTLTCVFWKEGARKQPWGGWSPEGCRTEQPSHSQVLCRCNHLTYFAVLMQLSPALVPAELLAPLTYISLVGCSISIVASLITVLLHFHFRKQSDSLTRIHMNLHASVLLLNIAFLLSPAFAMSPVPGSACTALAAALHYALLSCLTWMAIEGFNLYLLLGRVYNIYIRRYVFKLGVLGWGAPALLVLLSLSVKSSVYGPCTIPVFDSWENGTGFQNMSICWVRSPVVHSVLVMGYGGLTSLFNLVVLAWALWTLRRLRERADAPSVRACHDTVTVLGLTVLLGTTWALAFFSFGVFLLPQLFLFTILNSLYGKGGGTVSKKSDDTTVFLKNDETAWGKLLCLPYSGFFFSKPISSLAMIRGNTPAPVGGDDIPAIYEVEHFQQEQV

SEQ ID NO: 10478 - protein, 451 aa, Artificial Sequence
  Description of Artificial Sequence: Synthetic coding sequence
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLEGYTLTCVFWKEGARKQPWGGWSPEGCRTEQPSHSQVLCRCNHLTYFAVLMQLSPALVPAELLAPLTYISLVGCSISIVASLITVLLHFHFRKQSDSLTRIHMNLHASVLLLNIAFLLSPAFAMSPVPGSACTALAAALHYALLSCLTWMAIEGFNLYLLLGRVYNIYIRRYVFKLGVLGWDAGCGAPWCTVSWSWATAASRPSSTWWCWPGRCGPCAGCGSGRMHQVSGPAMTLSLCWASPCCWEPPGPWPSFLLASSCCPSCSSSPS

SEQ ID NO: 10479 - protein, 1346 aa, Artificial Sequence
  Description of Artificial Sequence: Synthetic coding sequence
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHTGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSMVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 10480 - protein, 1346 aa, Artificial Sequence; identical to SEQ ID NO: 10479
  Description of Artificial Sequence: Synthetic coding sequence

SEQ ID NO: 10481 - protein, 1326 aa, Artificial Sequence
  Description of Artificial Sequence: Synthetic coding sequence
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHTGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSMVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKSTSLGSSTPVFSMSSPISRRFNNLFGKTGTYNVSTPEATSSSLENSSSASSLLN

SEQ ID NO: 10482 - protein, 1346 aa, Artificial Sequence; identical to SEQ ID NO: 10479
  Description of Artificial Sequence: Synthetic coding sequence

SEQ ID NO: 10483 - protein, 1204 aa, Artificial Sequence
  Description of Artificial Sequence: Synthetic coding sequence
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTIRTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHTGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSMVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 10484 - protein, 717 aa, Artificial Sequence
  Description of Artificial Sequence: Synthetic coding sequence
DYRSQVHVESREGLWKIKGKIKKLGSSEKVTESKGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSMVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 10485 - protein, 770 aa, Artificial Sequence
  Description of Artificial Sequence: Synthetic coding sequence
MVDPLEATVSCSGSHHIKCCIEEDGDYKVTFHTGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSMVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTAAPKIPPGHDGNLVSGGSSAI

SEQ ID NO: 10486 - protein, 335 aa, Artificial Sequence
  Description of Artificial Sequence: Synthetic coding sequence
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 10487 - protein, 494 aa, Artificial Sequence
  Description of Artificial Sequence: Synthetic coding sequence
MEEPQPPRPPASMALLGSQHSGAPSAAGPPGGTSSAATAAVLSFSTVATAALGNLSDASGGGTAAAPGGGGLGGSGAAREAGAAVRRPLGPEAAPLLSHGAAVAAQALVLLLIFLLSSLGNCAVMGVIVKHRQLRTVTNAFILSLSLSDLLTALLCLPAAFLDLFTPPGGSAPAAAAGPWRGFCAASRFFSSCFGIVSTLSVALISLDRYCAIVRPPREKIGRRRALQLLAGAWLTALGFSLPWELLGAPRELAAAQSFHGCLYRTSPDPAQLGAAFSVGLVVACYLLPFLLMCFCHYHICKTVRLSDVRVRPVNTYARVLRFFSEVRTATTVLIMIVFVICCWGPYCFLVLLAAARQAQTMQAPSLLSVVAVWLTWANGAINPVIYAIRNPNISMLLGRNREEGYRTRNVDAFLPSQGPGLQARSRSRLRNRYANRLGACNRMSSSNPASGVAGDVAMWARKNPVVLFCREGPPEPVTAVTKQPKSEAGDTSL

SEQ ID NO: 10488 - protein, 494 aa, Artificial Sequence; identical to SEQ ID NO: 10487
  Description of Artificial Sequence: Synthetic coding sequence

SEQ ID NO: 10489 - protein, 322 aa, Artificial Sequence
  Description of Artificial Sequence: Synthetic coding sequence
MALLGSQHSGAPSAAGPPGGTSSAATAAVLSFSTVATAALGNLSDASGGGTAAAPGGGGLGGSGAAREAGAAVRRPLGPEAAPLLSHGAAVAAQALVLLLIFLLSSLGNCAVMGVIVKHRQLRTVTNAFILSLSLSDLLTALLCLPAAFLDLFTPPGGSAPAAAAGPWRGFCAASRFFSSCFGIVHAQRGAHLVGPLLRYRRPPREKIGRRRALQLLAGAWLTALGFSLPWELLGAPRELAAAQSFHGCLYRTSPDPAQLGAAFSVGLVVACYLLPFLLMCFCHYHICKTVRLSDVRVRPVNTYARVLRSSARCARPPPSSS

SEQ ID NO: 10490 - protein, 417 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQADLVNDLGNKGYLVFGLILFVWELLPTTLLVGFFRVHRPPQDLSTSHILNGQVFASRSYFFDRAGHCEDEGCSWEHSRGESTRCQDQAATTTVSTPPHRRDPPPSPTEYPGPSPPHPRPLCQVCLPLLAQDPGGRGYPLLWPAPCCSCHSELVPSP

SEQ ID NO: 10491 - protein, 346 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKADLVNDLGNKGYLVFGLILFVWELLPTTLLVGFFRVHRPPQDLSTSHILNGQVFASRSYFFDRAGHCEDEGCSWEHSRGESTSMSGSLGSGSWYGAIGREPGWYGGSQTKTTPLLFSQVPGPGGHHHSLYSTPQT

SEQ ID NO: 10492 - protein, 475 aa, Artificial Sequence
  Description of Artificial Sequence: Synthetic coding sequence
MLWAVRTRCYVVKAQLGPTVALEGRAPRAPGPSCLGNGNCQRPGPITSRNVTRASLPDMESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQADLVNDLGNKGYLVFGLILFVWELLPTTLLVGFFRVHRPPQDLSTSHILNGQVFASRSYFFDRAGHCEDEGCSWEHSRGESTRCQDQAATTTVSTPPHRRDPPPSPTEYPGPSPPHPRPLCQVCLPLLAQDPGGRGYPLLWPAPCCSCHSELVPSP

SEQ ID NO: 10493 - protein, 396 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQADLVNDLGNKGYLVFGLILFVWELLPTTLLVGFFRVHRPPQDLSTSHILNGQVFASRSYFFDRAGHCEDEGCSWEHSRGESTSMSGSLGSGSWYGAIGREPGWYGGSQTKTTPLLFSQVPGPGGHHHSLYSTPQT

SEQ ID NO: 10494 - protein, 132 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEM

SEQ ID NO: 10495 - protein, 167 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQ

SEQ ID NO: 10496 - protein, 63 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFL

SEQ ID NO: 10497 - protein, 220 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAA

SEQ ID NO: 10498 - protein, 320 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQADLVNDLGNKGYLVFGLILFVWELLPTTLLVGFFRVHRPPQDLYVGQSRLWELVWCHRA

SEQ ID NO: 10499 - protein, 78 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFLALCLLWAALRTTLFS

SEQ ID NO: 10500 - protein, 211 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVAGGRPPLASTWRPR

SEQ ID NO: 10501 - protein, 240 aa, Artificial Sequence
  Description of Artificial Sequence: Synthetic coding sequence
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTAL

SEQ ID NO: 10502 - protein, 233 aa, Artificial Sequence
  Description of Artificial Sequence: Synthetic coding sequence
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQGSSVCQVTAIGVTVILLYTSRACYNLFILSFSQNKSVHSFDYDWYNVSDQVSGGAEEVSPDQGLLVSSRHWFQDPRKYQNLDAQVPDIKWCSICI

SEQ ID NO: 10503 - protein, 399 aa, Artificial Sequence
  Description of Artificial Sequence: Synthetic coding sequence
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRYDSDDDLAWNIAPQGLQGGFAPDYYDWGQQTNSFLAQAGTLQDSTLDPDKPSLG

SEQ ID NO: 10504 - protein, 398 aa, Artificial Sequence [sequence omitted]

SEQ ID NO: 10505 - protein, 128 aa, Artificial Sequence
  Description of Artificial Sequence: Synthetic coding sequence
MSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRY

SEQ ID NO: 10506 - protein, 230 aa, Artificial Sequence
  Description of Artificial Sequence: Synthetic coding sequence
  MOD_RES (1)..(1): Any amino acid
XQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRYDSDDDLAWNIAPQGLQGGLL

SEQ ID NO: 10507 - protein, 429 aa, Artificial Sequence
  Description of Artificial Sequence: Synthetic coding sequence
MRVSVPGPAAAAAPAAGREPSTPGGGSGGGGAVAAASGAAVPGSVQLALSVLHALLYAALFAFAYLQLWRLLLYRERRLSYQSLCLFLCLLWAALRTTLFSAAFSLSGSLPLLRPPAHLHFFPHWLLYCFPSCLQFSTLCLLNLYLAEVICKVRCATELDRHKILLHLGFIMASLLFLVVNLTCAMLVHGDVPENQLKWTVFVRALINDSLFILCAISLVCYICKITKMSSANVYLESKGMSLCQTVVVGSVVILLYSSRACYNLVVVTISQDTLESPFNYGWDNLSDKAHVEDISGEEYIVFGMVLFLWEHVPAWSVVLFFRAQRLNQNLAPAGMINSHSYSSRAYFFDNPRRYDSDDDLPRLGSSREGSLPNSQSLGWYGTMTGCGSSSYTVTPHLNGPMTDTAPLLFTCSNLDLNNHHSLYVTPQN

SEQ ID NO: 10508 - protein, 353 aa, Artificial Sequence
  Description of Artificial Sequence: Synthetic coding sequence
MEHTHAHLAANSSLSWWSPGSACGLGFVPVVYYSLLLCLGLPANILTVIILSQLVARRQKSSYNYLLALAAADILVLFFIVFVDFLLEDFILNMQMPQVPDKIIEVLEFSSIHTSIWITVPLTIDRYIAVCHPLKYHTVSYPARTRKVIVSVYITCFLTSIPYYWWPNIWTEDYISTSVHHVLIWIHCFTVYLVPCSIFFILNSIIVYKLRRKSNFRLRGYSTGKTTAILFTITSIFATLWAPRIIMILYHLYGAPIQNRWLVHIMSDIANMLALLNTAINFFLYCFISKRFRTMAAATLKAFFKCQKQPVQFYTNHNFSITSSPWISPANSHCIKMLVYQYDKNGKPIKVSP

SEQ ID NO: 10509 - protein, 353 aa, Artificial Sequence; identical to SEQ ID NO: 10508
  Description of Artificial Sequence: Synthetic coding sequence

SEQ ID NO: 10510 - protein, 305 aa, Artificial Sequence
  Description of Artificial Sequence: Synthetic coding sequence
MPGHNTSRNSSCDPIVTPHLISLYFIVLIGGLVGVISILFLLVKMNTRSVTTMAVINLVVVHSVFLLTVPFRLTYLIKKTWMFGLPFCKFVSAMLHIHMYLTFLFYVVILVTRYLIFFKCKDKVEFYRKLHAVAASAGMWTLVIVIVVPLVVSRYGIHEEYNEEHCFKFHKELAYTYVKIINYMIVIFVIAVAVILLVFQVFIIMLMVQKLRHSLLSHQEFWAQLKNLFFIGVILVCFLPYQFFRIYYLNVVTHSNACNSKVAFYNEIFLSVTAISCYDLLLFVFGGSHWFKQKIIGLWNCVLCR

SEQ ID NO: 10511 - protein, 305 aa, Artificial Sequence; identical to SEQ ID NO: 10510
  Description of Artificial Sequence: Synthetic coding sequence

SEQ ID NO: 10512 - protein, 104 aa, Artificial Sequence
  Description of Artificial Sequence: Synthetic coding sequence
MPGHNTSRNSSCDPIVTPHLISLYFIVLIGGLVGVISILFLLVKMNTRSVTTMAVINLVVVHSVFLLTVPFRLTYLIKKTWMFGLPFCKFVSAMLHIHMYLTFL

SEQ ID NO: 10513 - protein, 462 aa, Artificial Sequence
  Description of Artificial Sequence: Synthetic coding sequence
MSIMMLPMEQKIQWVPTSLQDITAVLGTEAYTEEDKSMVSHAQKSQHSCLSHSRWLRSPQVTGGSWDLRIRPSKDSSSFRQAQCLRKDPGANNHLESQGVRGTAGDADRELRGPSEKATAGQPRVTLLPTPHVSGLSQEFESHWPEIAERSPCVAGVIPVIYYSVLLGLGLPVSLLTAVALARLATRTRRPSYYYLLALTASDIIIQVVIVFAGFLLQGAVLARQVPQAVVRTANILEFAANHASVWIAILLTVDRYTALCHPLHHRAASSPGRTRRAIAAVLSAALLTGIPFYWWLDMWRDTDSPRTLDEVLKWAHCLTVYFIPCGVFLVTNSAIIHRLRRRGRSGLQPRVGKSTAILLGITTLFTLLWAPRVFVMLYHMYVAPVHRDWRVHLALDVANMVAMLHTAANFGLYCFVSKTFRATVRQVIHDAYLPCTLASQPEGMAAKPVMEPPGLPTGAEV

SEQ ID NO: 10514 - protein, 963 aa, Artificial Sequence
  Description of Artificial Sequence: Synthetic coding sequence
MDAPWGAGERWLHGAAVDRSGVSLGPPPTPQVNQGTLGPQVAPVAAGEVVKTAGGVCKFSGQRLSWWQAQESCEQQFGHLALQPPDGVLASRLRDPVWVGQREAPLRRPPQRRARTTAVLVFDERTADRAARLRSPLPELAALTACTHVQWDCASPDPAALFSVAAPALPNALQLRAFAEPGGVVRAALVVRGQHAPFLAAFRADGRWHHVCATWEQRGGRWALFSDGRRRAGARGLGAGHPVPSGGILVLGQDQDSLGGGFSVRHALSGNLTDFHLWARALSPAQLHRARACAPPSEGLLFRWDPGALDVTPSLLPTVWVRLLCPVPSEECPTWNPGPRSEGSELCLEPQPFLCCYRTEPYRRLQDAQSWPGQDVISRVNALANDIVLLPDPLSEVHGALSPAEASSFLGLLEHVLAMEMAPLGPAALLAVVRFLKRVVALGAGDPELLLTGPWEQLSQGVVSVASLVLEEQVADTWLSLREVIGGPMALVASVQRLAPLLSTSMTSERPRMRIQHRHAGLSGVTVIHSWFTSRVFQHTLEGPDLEPQAPASSEEANRVQRFLSTQVGSAIISSEVWDVTGEVNVAMTFHLQHRAQSPLFPPHPPSPYTGGAWATTGCSVAALYLDSTACFCNHSTSFAILLQIYEVQRGPEEESLLRTLSFVGCGVSFCALTTTFLLFLVAGVPKSERTTVHKNLTFSLASAEGFLMTSEWAKANEVACVAVTVAMHFLFLVAFSWMLVEGLLLWRKVVAVSMHPGPGMRLYHATGWGVPVGIVAVTLAMLPHDYVAPGHCWLNVHTNAIWAFVGPVLFVLTANTCILARVVMITVSSARRRARMLSPQPCLQQQIWTQIWATVKPVLVLLPVLGLTWLAGILVHLSPAWAYAAVGLNSIQGLYIFLVYAACNEEVRSALQRMAEKKVAEVLRALGVWGGAAKEHSLPFSVLPLFLPPKPSTPRHPLKAPA

SEQ ID NO: 10515 - protein, 367 aa, Artificial Sequence
  Description of Artificial Sequence: Synthetic coding sequence
LTDFHLWARALSPAQLHRARACAPPSEGLLFRWDPGALDVTPSLLPTVWVRLLCPEPYRRLQDAQSWPGQDVISRVNALANDIVLLPDPLSEVHGALSPAEASSFLGLLEHVLAMEMAPLGPAALLAVVRFLKRVVALGAGDPELLLTGPWEQLSQGVVSVASLVLEEQVIGGPMALVASVQRLAPLLSTSMTSERPRMRIQHRHAGLEVRSLRLREASTRGCLFTMPGGRPEGPGHIHIPASEVRRLLRKGLSGVTVIHSWFTSRVFQHTLEGPDLEPQAPASSEEANRVQRFLSTQVGSAIISSEVWDVTGEVNVAMTFHLQHRAQPIYRGCLGHHRLLRGCPVPGLHRLLLQPQHQLCHPAANL

SEQ ID NO: 10516 - protein, 130 aa, Artificial Sequence
  Description of Artificial Sequence: Synthetic coding sequence
SGGILLDAGGGAAAVEEGGSCEHAPGPRHAALPRHRLGATVKPVLVLLPVLGLTWLAGILVHLSPAWAYAAVGLNSIQGLYIFLVYAACNEEVRSALQRMAEKKVAEGPMALELPQHSPPLQTRRDRLWN

SEQ ID NO: 10517 - protein, 34 aa, Artificial Sequence
  Description of Artificial Sequence: Synthetic coding sequence
MHPPPSLLSFLAPVAAGEVVKTAGGVCKFSGQRL

SEQ ID NO: 10518 - protein, 333 aa, Artificial Sequence
  Description of Artificial Sequence: Synthetic coding sequence
MWSCSWFNGTGLVEELPACQDLQLGLSLLSLLGLVVGVPVGLCYNALLVLANLHSKASMTMPDVYFVNMAVAGLVLSALAPVHLLGPPSSRWALWSVGGEVHVALQIPFNVSSLVAMYSTALLSLDHYIERALPRTYMASVYNTRHVCGFVWGGALLTSFSSLLFYICSHVSTRALECAKMQNAEAADATLVFIGYVVPALATLYALVLLSRVRREDTPLDRDTGRLEPSAHRLLVATVCTQFGLWTPHYLILLGHTVIISRGKPVDAHYLGLLHFVKDFSKLLAFSSSFVTPLLYRYMNQSFPSKLQRLMKKLPCGDRHCSPDHMGVQQVLA

SEQ ID NO: 10519 - protein, 333 aa, Artificial Sequence; identical to SEQ ID NO: 10518
  Description of Artificial Sequence: Synthetic coding sequence

SEQ ID NO: 10520 - protein, 315 aa, Artificial Sequence
  Description of Artificial Sequence: Synthetic coding sequence
MWSCSWFNGTGLVEELPACQDLQLGLSLLSLLGLVVGVPVGLCYNALLVLANLHSKASMTMPDVYFVNMAVAGLVLSALAPVHLLGPPSSRWALWSVGGEVHVALQIPFNVSSLVAMYSTALLSLDHYIERALPRTYMASVYNTRHVCGFVWGGALLTSFSSLLFYICSHVSTRALECAKMQNAEAADATLVFIGYVVPALATLYALVLLSRVRREDTPLDRDTGRLEPSAHRLLVATVCTQFGLWTPHYLILLGHTVIISRGKPVDAHYLGLLHFVKDFSKLLAFSSSFVTPLLYRYMNQSFPSKLQRLMKKLP

SEQ ID NO: 10521 - protein, 251 aa, Artificial Sequence
  Description of Artificial Sequence: Synthetic coding sequence
MLLGPPSSRWALWSVGGEVHVALQIPFNVSSLVAMYSTALLSLDHYIERALPRTYMASVYNTRHVCGFVWGGALLTSFSSLLFYICSHVSTRALECAKMQNAEAADATLVFIGYVVPALATLYALVLLSRVRREDTPLDRDTGRLEPSAHRLLVATVCTQFGLWTPHYLILLGHTVIISRGKPVDAHYLGLLHFVKDFSKLLAFSSSFVTPLLYRYMNQSFPSKLQRLMKKLPCGDRHCSPDHMGVQQVLA

SEQ ID NO: 10522 - protein, 347 aa, Artificial Sequence
  Description of Artificial Sequence: Synthetic coding sequence
MGDELAPCPVGTTAWPALIQLISKTPCMPQAASNTSLGLGDLRVPSSMLYWLFLPSSLLAAATLAVSPLLLVTILRNQRLRQEPHYLLPANILLSDLAYILLHMLISSSSLGGWELGRMACGILTDAVFAACTSTILSFTAIVLHTYLAVIHPLRYLSFMSHGAAWKAVALIWLVACCFPTFLIWLSKWQDAQLEEQGASYILPPSMGTQPGCGLLVIVTYTSILCVLFLCTALIANCFWRIYAEAKTSGIWGQGYSRARGTLLIHSVLITLYVSTGVVFSLDMVLTRYHHIDSGTHTWLLAANSEVLMMLPRAMLTYLYLLRYRQLLGMVRGHLPSRRHQAIFTIS

SEQ ID NO: 10523 - protein, 731 aa, Artificial Sequence
  Description of Artificial Sequence: Synthetic coding sequence
MSLFLSNLSTNDSSLWKENHNSTDLLNPPGTLNIYLFCLTCLMTFAALVGSIYSLISLLKMQNRTVVSMLVASWSVDDLMSVLSVTIFMFLQWPNEVPGYFQFLCTTSALMYLCQGLSSNLKATLLVSYNFYTMHRGVGSQTASRRSGQVLGVVLTVWAASLLLSALPLCGWGAFVRTPWGCLVDCSSSYVLFLSIVYALAFGLLVGLSVPLTHRLLCSEEPPRLHSNYQEISRGASIPGTPPTAGRVVSLSPEDAPGPSLRRSGGCSPSSDTVFGPGAPAAAGAEACRRENRGTLYGTRSFTVSVAQKRFALILALTKVVLWLPMMMHMVVQNVVGFQSLPLETFSFLLTLLATTVTPVFVLSKRWTHLPCGCIINCRQNAYAVASDGKKIKRKGFEFNLSFQKSYGIYKIAHEDYYDDDENSIFYHNLMNSECETTKDPQRDNRNIFNAIKVEISTTPSLDSSTQRGINKCTNTDITEAKQDSNNKKDAFSDKTGGDINYEETTFSEGPERRLSHEESQKPDLSDWEWCRSKSERTPRQRSGYALAIPLCAFQGTVSLHAPTGKTLSLSTYEVSAEGQKITPASKKIEVYRSKSVGHEPNSEDSSSTFVDTSVKIHLEVLEICDNEEALDTVSIISNISQSSTQVRSPSLRYSRKENRFVSCDLGETASYSLFLPTSNPDGDINISIPDTVEAHRQNSKRQHQERDGYQEEIQLLNKAYRKREEESKGS

SEQ ID NO: 10524 - protein, 434 aa, Artificial Sequence
  Description of Artificial Sequence: Synthetic coding sequence
MEDLFSPSILPPAPNISVPILLGWGLNLTLGQGAPASGPPSRRVRLVFLGVILVVAVAGNTTVLCRLCGGGGPWAGPKRRKMDFLLVQLALADLYACGGTALSQLAWELLGEPRAATGDLACRFLQLLQASGRGASAHLVVLIALERRRAVRLPHGRPLPARALAALGWLLALLLALPPAFVVRGDSPSPLPPPPPPTSLQPGAPPAARAWPGERRCHGIFAPLPRWHLQVYAFYEAVAGFVAPVTVLGVACGHLLSVWWRHRPQAPAAAAPWSASPGRAPAPSALPRAKVQSLKMSLLLALLFVGCELPYFAARLAAAWSSGPAGDWEGEGLSAALRVVAMANSALNPFVYLFFQAGDCRLRRQLRKRLGSLCCAPQGGAEDEEGPRGHQALYRQRWPHPHYHHARREPLDEGGLRPPPPRPRPLPCSCESAF

SEQ ID NO: 10525 - protein, 419 aa, Artificial Sequence
  Description of Artificial Sequence: Synthetic coding sequence
MLAAAFADSNSSSMNVSFAHLHFAGGYLPSDSQDWRTIIPALLVAVCLVGFVGNLCVIGILLHNAWKGKPSMIHSLILNLSLADLSLLLFSAPIRATAYSKSVWDLGWFVCKSSDWFIHTCMAAKSLTIVVVAKVCFMYASDPAKQVSIHNYTIWSVLVAIWTVASLLPLPEWFFSTIRHHEGVEMCLVDVPAVAEEFMSMFGKLYPLLAFGLPLFFASFYFWRAYDQCKKRGTKTQNLRNQIRSKQVTVMLLSIAIISALLWLPEWVAWLWVWHLKAAGPAPPQGFIALSQVLMFSISSANPLIFLVMSEEFREGLKGVWKWMITKKPPTVSESQETPAGNSEGLPDKVPSPESPASIPEKEKPSSPSSGKGKTEKAEIPILPDVEQFWHERDTVPSVQDNDPIPWEHEDQETGEGVK

SEQ ID NO: 10526 - protein, 470 aa, Artificial Sequence
  Description of Artificial Sequence: Synthetic coding sequence
MDTTMEADLGATGHRPRTELDDEDSYPQGGWDTVFLVALLLLGLPANGLMAWLAGSQARHGAGTRLALLLLSLALSDFLFLAAAAFQILEIRHGGHWPLGTAACRFYYFLWGVSYSSGLFLLAALSLDRCLLALCPHWYPGHRPVRLPLWVCAGVWVLATLFSVPWLVFPEAAVWWYDLVICLDFWDSEELSLRMLEVLGGFLPFLLLLVCHVLTQATACRTCHRQQQPAACRGFARVARTILSAYVVLRLPYQLAQLLYLAFLWDVYSGYLLWEALVYSDYLILLNSCLSPFLCLMASADLRTLLRSVLSSFAAALCEERPGSFTPTEPQTQLDSEGPTLPEPMAEAQSQMDPVAQPQVNPTLQPRSDPTAQPQLNPTAQPQSDPTAQPQLNLMAQPQSDSVAQPQADTNVQTPAPAASSVPSPCDEASPTPSSHPTPGALEDPATPPASEGESPSSTPPEAAPGAGPT

SEQ ID NO: 10527 - protein, 870 aa, Artificial Sequence
  Description of Artificial Sequence: Synthetic coding sequence
MNSNLPAENLTIAVNMTKTLPTAVTHGFNSTNDPPSMSITRLFPALLECFGIVLCGYIAGRANVITSTQAKGLGNFVSRFALPALLFKNMVVLNFSNVDWSFLYSILIAKASVFFIVCVLTLLVASPDSRFSKAGLFPIFATQSNDFALGYPIVEALYQTTYPEYLQYIYLVAPISLMMLNPIGFIFCEIQKWKDTQNASQNKIKIVGLGLLRVLQNPIVFMVFIGIAFNFILDRKVPVYVENFLDGLGNSFSGSALFYLGLTMVGKIKRLKKSAFVVLILLITAKLLVLPLLCREMVELLDKGDSVVNHTSLSNYAFLYGVFPVAPGVAIFATQFNMEVEIITSGMVISTFVSAPIMYVSAWLLTFPTMDPKPLAYAIQNVSFDISIVSLISLIWSLAILLLSKKYKQLPHMLTTNLLIAQSIVCAGMMIWNFVKEKNFVGQILVFVLLYSSLYSTYLWTGLLAISLFLLKKRERVQIPVGIIIISGWGIPALLVGVLLITGKHNGDSIDSAFFYGKEQMITTAVTLFCSILIAGISLMCMNQTAQAGSYEGFDQSQSHKVVEPGNTAFEESPAPVNEPELFTSSIPETSCCSCSMGNGELHCPSIEPIANTSTSEPVIPSFEKNNHCVSRCNSQSCILAQEEEQYLQSGDQQLTRHVLLCLLLIIGLFANLSSCLWWLFNQEPGRLYVELQFFCAVFNFGQGFISFGIFGLDKHLIILPFKRRLEFLWNNKDTAENRDSPVSEEIKMTCQQFIHYHRDLCIRNIVKERRCGAKTSAGTFCGCDLVSWLIEVGLASDRGEAVIYGDRLVQGGVIQHITNEYEFRDEYLFYRFLQKSPEQSPPAINANTLQQERYKEIEHSSPPSHSPKT

SEQ ID NO: 10528 - protein, 870 aa, Artificial Sequence; identical to SEQ ID NO: 10527
  Description of Artificial Sequence: Synthetic coding sequence

SEQ ID NO: 10529 - protein, 870 aa, Artificial Sequence; identical to SEQ ID NO: 10527
  Description of Artificial Sequence: Synthetic coding sequence

SEQ ID NO: 10530 - protein, 264 aa, Artificial Sequence
  Description of Artificial Sequence: Synthetic coding sequence
MITTAVTLFCSILIAGISLMCMNQTAQAGSYEGFDQSQSHKVVEPGNTAFEESPAPVNEPELFTSSIPETSCCSCSMGNGELHCPSIEPIANTSTSEPVIPSFEKNNHCVSRCNSQSCILAQEEEQYLQSGDQQLTRHVLLCLLLIIGLFANLSSCLWWLFNQEPGRLYVELQFFCAVFNFGQGFISFGIFGLDKHLIILPFKRRLEFLWNNKDTAENRDSPVSEEIKMTCQQFIHYHRDLCIRNIVKERRCGAKTSAGTFCGC

SEQ ID NO: 10531 - protein, 138 aa, Artificial Sequence
  Description of Artificial Sequence: Synthetic coding sequence
FRARGPDGRGSGRTRAGRAPGREPRAPRCPDGGGVAARAARLLSSRRSGSWPPTHALWPDLRSRARRLLLFLSLADLLSARCPPSPTPAPSSGPWPLRSTCTSASSAPRAGLAQIACFGPSMSSAGGSRWSSLWQPSP

SEQ ID NO: 10532 - protein, 335 aa, Artificial Sequence
  Description of Artificial Sequence: Synthetic coding sequence
MQPSPPPTELVPSERAVVLLSCALSALGSGLLVATHALWPDLRSRARRLLLFLSLADLLSAASYFYGVLQNFAGPSWDCVLQGALSTFANTSSFFWTVAIALYLYLSIVRAARGPRTDRLLWAFHVVSWGVPLVITVAAVALKKIGYDASDVSVGWCWIDLEAKDHVLWMLLTGKLWEMLAYVLLPLLYLLVRKHINRAHTALSEYRPILSQEHRLLRHSSMADKKLVLIPLIFIGLRVWSTVRFVLTLCGSPAVQTPVLVVLHGIGNTFQGGANCIMFVLCTRAVRTRLFSLCCCCCSSQPPTKSPAGTPKAPAPSKPGESQESQGTPGELPST

SEQ ID NO: 10533 - protein, 270 aa, Artificial Sequence
  Description of Artificial Sequence: Synthetic coding sequence
MQPSPPPTELVPSERAVVLLSCALSALGSGLLVATHALWPDLRSRARRLLLFLSLADLLSAASYFYGVLQNFAGPSWDCVLQGALSTFANTSSFFWTVAIALYLYLSIVRAARGPRTDRLLWAFHVVSWGVPLVITVAAVALKKIGYDASDVSVGWCWIDLEAKDHVLWMLLTGKLWEMLAYVLLPLLYLLVRKHINRAGIGNTFQGGANCIMFVLCTRAVRTRLFSLCCCCCSSQPPTKSPAGTPKAPAPSKPGESQESQGTPGELPST

SEQ ID NO: 10534 - protein, 1215 aa, Artificial Sequence
  Description of Artificial Sequence: Synthetic coding sequence
MGAMAYPLLLCLLLAQLGLGAVGASRDPQGRPDSPRERTPKGKPHAQQPGRASASDSSAPWSRSTDGTILAQKLAEEVPMDVASYLYTGDSHQLKRANCSGRYELAGLPGKWPALASAHPSLHRALDTLTHATNFLNVMLQSNKSREQNLQDDLDWYQALVWSLLEGEPSISRAAITFSTDSLSAPAPQVFLQATREESRILLQDLSSSAPHLANATLETEWFHGLRRKWRPHLHRRGPNQGPRGLGHSWRRKDGLGGDKSHFKWSPPYLECENGSYKPGWLVTLSSAIYGLQPNLVPEFRGVMKVDINLQKVDIDQCSSDGWFSGTHKCHLNNSECMPIKGLGFVLGAYECICKAGFYHPGVLPVNNFRRRGPDQHISGSTKDVSEEAYVCLPCREGCPFCADDSPCFVQEDKYLRLAIISFQALCMLLDFVSMLVVYHFRKAKSIRASGLILLETILFGSLLLYFPVVILYFEPSTFRCILLRWARLLGFATVYGTVTLKLHRVLKVFLSRTAQRIPYMTGGRVMRMLAVILLVVFWFLIGWTSSVCQNLEKQISLIGQGKTSDHLIFNMCLIDRWDYMTAVAEFLFLLWGVYLCYAVRTVPSAFHEPRYMAVAVHNELIISAIFHTIRFVLASRLQSDWMLMLYFAHTHLTVTVTIGLLLIPKFSHSSNNPRDDIATEAYEDELDMGRSGSYLNSSINSAWSEHSLDPEDIRDELKKLYAQLEIYKRKKMITNNPHLQKKRCSKKGLGRSIMRRITEIPETVSRQCSKEDKEGADHGTAKGTALIRKNPPESSGNTGKSKEETLKNRVFSLKKSHSTYDHVRDQTEESSSLPTESQEEETTENSTLESLSGKKLTQKLKEDSEAESTESVPLVCKSASAHNLSSEKKTGHPRTSMLQKSLSVIASAKEKTLGLAGKTQTAGVEERTKSQKPLPKDKETNRNHSNSDNTETKDPAPQNSNPAEEPRKPQKSGIMKQQRVNPTTANSDLNPGTTQMKDNFDIGEVCPWEVYDLTPGPVPSESKVQKHVSIVASEMEKNPTFSLKEKSHHKPKAAEVCQQSNQKRIDKAEVCLWESQGQSILEDEKLLISKTPVLPERAKEENGGQPRAANVCAGQSEELPPKAVASKTENENLNQIGHQEKKTSSSEENVRGSYNSSNNFQQPLTSRAEVCPWEFETPAQPNAGRSVALPASSALSANKIAGPRKEEIWDSFKV

SEQ ID NO: 10535 - protein, 338 aa, Artificial Sequence
  Description of Artificial Sequence: Synthetic coding sequence
MTALSSENCSFQYQLRQTNQPLDVNYLLFLIILGKILLNILTLGMRRKNTCQNFMEYFCISLAFVDLLLLVNISIILYFRDFVLLSIRFTKYHICLFTQIISFTYGFLHYPVFLTACIDYCLNFSKTTKLSFKCQKLFYFFTVILIWISVLAYVLGDPAIYQSLKAQNAYSRHCPFYVSIQSYWLSFFMVMILFVAFITCWEEVTTLVQAIRITSYMNETILYFPFSSHSSYTVRSKKIFLSKLIVCFLSTWLPFVLLQVIIVLLKVQIPAYIEMNIPWLYFVNSFLIATVYWFNCHKLNLKDIGLPLDPFVNWKCCFIPLTIPNLEQIEKPISIMIC

SEQ ID NO: 10536 - protein, 143 aa, Artificial Sequence
  Description of Artificial Sequence: Synthetic coding sequence
MTALSSENCSFQYQLRQTNQPLDVNYLLFLIILGKILLNILTLGMRRKNTCQNFMEYFCISLAFVDLLLLVNISIILYFRDFVLLSIRFTKYHICLFTQIISFTYGFLHYPVFLTACIDYCLNFSKTTKLSFKCQKLFYFFTV

SEQ ID NO: 10537 - protein, 88 aa, Artificial Sequence
  Description of Artificial Sequence: Synthetic coding sequence
MTALSSENCSFQYQLRQTNQPLDVNYLLFLIILGKILLNILTLGMRRKNTCQNFMEYFCISLAFVDLLLLVNISIILYFRDFVLLSIR

SEQ ID NO: 10538 - protein, 33 aa, Artificial Sequence
  Description of Artificial Sequence: Synthetic coding sequence
MTALSSENCSFQYQLRQTNQPLDVNYLLFLIIL

SEQ ID NO: 10539 - protein, 588 aa, Artificial Sequence
  Description of Artificial Sequence: Synthetic coding sequence
MARGGAGAEEASLRSNALSWLACGLLALLANAWIILSISAKQQKHKPLELLLCFLAGTHILMAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRVGGGGGTKAGGPGALGTRPAFEVPAIVVEDARGKRRSSLDGSESAKTSLQVTNLVSAIVFLYDSLTGVPILVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 10540 - protein, 304 aa, Artificial Sequence
  Description of Artificial Sequence: Synthetic coding sequence
MLSTGVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 10541 - protein, 319 aa, Artificial Sequence
  Description of Artificial Sequence: Synthetic coding sequence
MTNSSFFCPVYKDLEPFTYFFYLVFLVGIIGSCFATWAFIQKNTNHRCVSIYLINLLTADFLLTLALPVKIVVDLGVAPWKLKIFHCQVTACLIYINMYLSIIFLAFVSIDRCLQLTHSCKIYRIQEPGFAKMISTVVWLMVLLIMVPNMMIPIKDIKEKSNVGCMEFKKEFGRNWHLLTNFICVAIFLNFSAIILISNCLVIRQLYRNKDNENYPNVKKALINILLVTTGYIICFVPYHIVRIPYTLSQTEVITDCSTRISLFKAKEATLLLAVSNLCFDPILYYHLSKAFRSKVTETFASPKETKAQKEKLRCENNA

SEQ ID NO: 10542 - protein, 18 aa, Artificial Sequence
  Description of Artificial Sequence: Synthetic coding sequence
MTNSSFFCPVYKDLEPFT

SEQ ID NO: 10543 - protein, 373 aa, Artificial Sequence
  Description of Artificial Sequence: Synthetic coding sequence
MANTTGEPEEVSGALSPPSASAYVKLVLLGLIMCVSLAGNAILSLLVLKERALHKAPYYFLLDLCLADGIRSAVCFPFVLASVRHGSSWTFSALSCKIVAFMAVLFCFHAAFMLFCISVTRYMAIAHHRFYAKRMTLWTCAAVICMAWTLSVAMAFPPVFDVGTYKFIREEDQCIFEHRYFKANDTLGFMLMLAVLMAATHAVYGKLLLFEYRHRKMKPVQMVPAISQNWTFHGPGATGQAAANWIAGFGRGPMPPTLLGIRQNGHAASRRLLGMDEVKGEKQLGRMFYAITLLFLLLWSPYIVACYWRVFVKACAVPHRYLATAVWMSFAQAAVNPIVCFLLNKDLKKCLRTHAPCWGTGGAPAPREPYCVM

SEQ ID NO: 10544 - protein, 52 aa, Artificial Sequence
  Description of Artificial Sequence: Synthetic coding sequence
MANTTGEPEEVSGALSPPSASAYVKLVLLGLIMCVSLAGNAILSLLVLKERA

SEQ ID NO: 10545 - protein, 333 aa, Artificial Sequence
  Description of Artificial Sequence: Synthetic coding sequence
MPANYTCTRPDGDNTDFRYFIYAVTYTVILVPGLIGNILALWVFYGYMKETKRAVIFMINLAIADLLQVLSLPLRIFYYLNHDWPFGPGLCMFCFYLKYVNMYASIYFLVCISVRRFWFLMYPFRFHDCKQKYDLYISIAGWLIICLACVLFPLLRTSDDTSGNRTKCFVDLPTRNVNLAQSVVMMTIGELIGFVTPLLIVLYCTWKTVLSLQDKYPMAQDLGEKQKALKMILTCAGVFLICFAPYHFSFPLDFLVKSNEIKSCLARRVILIFHSVALCLASLNSCLDPVIYYFSTNEFRRRLSRQDLHDSIQLHAKSFVSNHTASTMTPELC

SEQ ID NO: 10546 - protein, 2367 aa, Artificial Sequence
  Description of Artificial Sequence: Synthetic coding sequence
MGTRGAVMPPPMWGLLGCCFVCAWALGGPRPIRSLPPLSSQVKPGSVPMQVPLEGAEAALAYLYSGDAQQLSQVNCSERYEARGAGAMPGLPPSLQGAAGTLAQAANFLNMLLQANDIRESSVEEDVEWYQALVRSVAEGDPRVYRALLTFNPPPGASHLQLALQATRTGEETILQDLSGNWVQEENPPGDLDTPALKKRVLTNDLGSLGSPKWPQADGYVGDTQQVRLSPPFLECQEGRLRPGWLITLSATFYGLKPDLSPEVRGQVQMDVDLQSVDINQCASGPGWYSNTHLCDLNSTQCVPLESQGFVLGRYLCRCRPGFYGASPSGGLEESDFQTTGQFGFPEGRSGRLLQCLPCPEGCTSCMDATPCLVEEAAVLRAAVLACQACCMLAIFLSMLVSYRCRRNKRIWASGVVLLETVLFGFLLLYFPVFILYFKPSVFRCIALRWVRLLGFAIVYGTIILKLYRVLQLFLSRTAQRSALLSSGRLLRRLGLLLLPVLGFLAVWTVGALERGIQHAPLVIRGHTPSGRHFYLCHHDRWDYIMVVAELLLLCWGSFLCYATRAVLSAFHEPRYMGIALHNELLLSAAFHTARFVLVPSLHPDWTLLLFFFHTHSTVTTTLALIFIPKFWKLGAPPREEMVDEVCEDELDLQHSGSYLGSSIASAWSEHSLDPGDIRDELKKLYAQLEVHKTKEMAANNPHLPKKRGSSCQGLGRSFMRYLAEFPEALARQHSRDSGSPGHGSLPGSSRRRLLSSSLQEPEGTPALHKSRSTYDQRREQDPPLLDSLLRRKLAKKASRTESRESVEGPPALGFRSASAHNLTVGERLPRARPASLQKSLSVASSREKALLMASQAYLEETYRQAKEREERKKAKAAMASLVRRPSARRLERPRGAPLSAPPSPAKSSSVDSSHTSGRLHEEARRRLPHPPIRHQVSTPILALSGGLGEPRMLSPTSTLAPALLPALAPTPAPALAPVPVSPQSPNLLTYICPWENAELPAKQENVPQEGPSGPERGHHSPAPARARLWRALSVAVEKSRAGENEMDAEDAHHQREANDVDEDRPKIFPKSHSLKAPVQQGSMRSLGLAIKALTRSRSTYREKESVEESPEGQNSGTAGESMGAPSRSPRLGRPKAVSKQAALIPSDDKESLQNQQNAHTSRMLQVCQREGSREQEDRGRRMTQGLGERKAERAGKTGLAMLRQVSRDKNIKQSKETPVGWQELPKAGLQSLGSADHRVAEVCPWEVTESETRQPDSGNKAEICPWETSEGAPESRALRQDPGDSQKKRGEARGKSEPIDVVPMMRKKPERLVREQEAVCPWESADRGGLSPGSAPQDPGRIRDKSEAGDSVEARKVEKPGWEAAGPEAHTPDITKAEPCPWEASEGGEDGKPAQEAVKDLPQEKQKTRKATFWKEQKPGGDLESLCPWESTDFRGPSAVSIQAPGSSECSGSLGSGIAEVCLWEAGDAPAIQKAEICPWELDDNVMGQEMLSLGTGRESLQEKEKASRKGSFGEMGEQTVKAVQKLSQQQESVCPRESTVPGHSSPCLDNSSSKAGSQFLCNGGSRATQVCPQEDLRPEAQEATPAKTEICPWEVNERTREEWTSAQVPRGGESQKDKEKMPGKSEIEDVTAWEKPEGQIQKQEAVGPWESVDPGSFSPQPRPQDTERPQTLLQMSGSVGSKAADICPLDVEENLTAGKAEICPWEVGAGAGEERALGAEAIRKSPNDTGKVSADLGPRERAVTAPEKPQKPTPEWEVACPWGSVGPGACSQHPGTLDADGPKAGFQELDHMGCRPGEVCPWEAQEAATSEKAKICPWEVSEGTTGKGLDQKAGSESAEQREKALEKGRLTSLGEDVSKGMAKLCQQQETICIWENKDLRESPAQAPKISDLPSSMSSEVAEGHSLEATEKGDLRQDPKTGSFPEHITQEKAPAADTEEFTTEDGEKTSHELQSVCPWETTAPADSVSHLDRQRPDQPKASSQRLVSTGGRAADVCPWDVPDAGVYKSDSSAKAETCPWEVTERIPVKGVSRQDGKGDSQEEKGRAPEKSEPKGVPVQKKPEMADFRQQEAVCPWESQDGKGLSPQPAPDASDRSRGSSEAAGSVETRVAEVCLWEVVEAPSAKKAEICPWEAGGGAAEEGEQERESQGQGEMFLQKAGPGGTEEHFSKAAAKPREQEAVCPGEGTGSGGLLPQSGALDPELKVSPKEAGSMGSRMAELCQWEITDPEGNKIKGTMADICPGEETGVPSEESGLLALTATRREFFPTAPEKPLCLLVHGPLDHFFPESKIPCPKVSRPASTFTLEGVRELQGPSGLEPRTSLAPEPSLQEAESQSSSLTEDSGQVAFEAQYEEFTPPTVYPWDWE

SEQ ID NO: 10547 - protein, 440 aa, Artificial Sequence
  Description of Artificial Sequence: Synthetic coding sequence
MGGLRLLAVALTCCWWPQGSQGKTLRGSFSSTAAQDAQGQRIGHFEFHGDHALLCVRINNIAVAVGKEAKLYLFQAQEWLKLQQSSHGYSCSEKLSKAQLTMTMNQTEHNLTVSQIPSPQTWHVFYADKYTCQDDKENSQVEDIPFEMVLLNPDAEGNPFDHFSAGESGLHEFFFLLVLVYFVIACIYAQSLWQAIKKGGPMHMILKVLTTALLLQAGSALANYIHFSSYSKDGIGVPFMGSLAEFFDIASQIQMLYLLLSLCMGWTIVRMKKSQSRPLQWDSTPASTGIAVFIVMTQSVLLLWEQFEDISHHSYHSHHNLAGILLIVLRICLALSLGCGLYQIITVERSTLKREFYITFAKGCILWFLCHPVLACISVIFSDYQRDKVITIGVILCQSVSMVILYRLFLSHSLYWEVSSLSSVTLPLTISSGHKSRPHF

SEQ ID NO: 10548 - protein, 404 aa, Artificial Sequence
  Description of Artificial Sequence: Synthetic coding sequence
MSVKPSWGPGPSEGVTAVPTSDLGEIHNWTELLDLFNHTLSECHVELSQSTKRVVLFALYLAMFVVGLVENLLVICVNWRGSGRAGLMNLYILNMAIADLGIVLSLPVWMLEVTLDYTWLWGSFSCRFTHYFYFVNMYSSIFFLVCLSVDRYVTLTSASPSWQRYQHRVRRAMCAGIWVLSAIIPLPEVVHIQLVEGPEPMCLFMAPFETYSTWALAVALSTTILGFLLPFPLITVFNVLTACRLRQPGQPKSRRHCLLLCAYVAVFVMCWLPYHVTLLLLTLHGTHISLHCHLVHLLYFFYDVIDCFSMLHCVINPILYNFLSPHFRGRLLNAVVHYLPKDQTKAGTCASSSSCSTQHSIIITKGDSQPAAAAPHPEPSLSFQAHHLLPNTSPISPTQPLTPS

SEQ ID NO: 10549 - protein, 481 aa, Artificial Sequence
  Description of Artificial Sequence: Synthetic coding sequence
MRWLWPLAVSLAVILAVGLSRVSGGAPLHLGRHRAETQEQQSRSKRGTEDEEAKGVQQYVPEEWAEYPRPIHPAGLQPTKPLVATSPNPGKDGGTPDSGQELRGNLTGAPGQRLQIQNPLYPVTESSYSAYAIMLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMTLAVPELLLWQLAQEPAPTMGTLDSCIMKPSASLPESLYSLVMTYQNARMWWYFGCYFCLPILFTVTCQLVTWRVRGPPGRKSECRASKHEQCESQLNSTVVGLTVVYAFCTLPENVCNIVVAYLSTELTRQTLDLLGLINQFSTFFKGAITPVLLLCICRPLGQAFLDCCCCCCCEECGGASEASAANGSDNKLKTEVSSSIYFHKPRESPPLLPLGTPC

SEQ ID NO: 10550 - protein, 348 aa, Artificial Sequence
  Description of Artificial Sequence: Synthetic coding sequence
MLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMTLAVPELLLWQLAQEPAPTMGTLDSCIMKPSASLPESLYSLVMTYQNARMWWYFGCYFCLPILFTVTCQLVTWRVRGPPGRKSECRASKHEQCESQLNSTVVGLTVVYAFCTLPENVCNIVVAYLSTELTRQTLDLLGLINQFSTFFKGAITPVLLLCICRPLGQAFLDCCCCCCCEECGGASEASAANGSDNKLKTEVSSSIYFHKPRESPPLLPLGTPC

SEQ ID NO: 10551 - protein, 337 aa, Artificial Sequence [sequence omitted]

SEQ ID NO: 10552 - protein, 337 aa, Artificial Sequence [sequence omitted]

SEQ ID NO: 10553 - protein, 384 aa, Artificial Sequence
  Description of Artificial Sequence: Synthetic coding sequence
MTNSSSTSTSSTTGGSLLLLCEEEESWAGRRIPVSLLYSGLAIGGTLANGMVIYLVSSFRKLQTTSNAFIVNGCAADLSVCALWMPQEAVLGLLPTGSAEPPADWDGAGGSYRLLRGGLLGLGLTVSLLSHCLVALNRYLLITRAPATYQALYQRRHTAGMLALSWALALGLVLLLPPWAPRPGAAPPRVHYPALLAAAALLAQTALLLHCYLGIVRRVRVSVKRVSVLNFHLLHQLPGCAAAAAAFPGAQHAPGPGGAAHPAQAQPLPPALHPRRAQRRLSGLSVLLLCCVFLLATQPLVWVSLASGFSLPVPWGVQAASWLLCCALSALNPLLYTWRNEEFRRSVRSVLPGVGDAAAAAVAATAVPAVSQAQLGTRAAGQHW

SEQ ID NO: 10554 - protein, 320 aa, Artificial Sequence
  Description of Artificial Sequence: Synthetic coding sequence
MFLGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 10555 - protein, 390 aa, Artificial Sequence
  Description of Artificial Sequence: Synthetic coding sequence
MTLTCVFWDVTKGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATAVKERGKNRKKVLTLLGLSSLVGVTWGLAIFTPLGLSTVYIFALFNSLQGSSVDCQALSAGEKLLSLLGLPQQPWKLRAAAHLPVRMLGADVDCKWMRFASPPSPQAVERQEGGPSLYARRCVPGREILGRGHCII

SEQ ID NO: 10556 - protein, 549 aa, Artificial Sequence
  Description of Artificial Sequence: Synthetic coding sequence
MATPRGLGALLLLLLLPTSGQEKPTEGPRNTCLGSNNMYDIFNLNDKALCFTKCRQSGSDSCNVENLQRYWLNYEAHLMKEGLTQKVNTPFLKALVQNLSTNTAEDFYFSLEPSQVPRQVMKDEDKPPDRVRLPKSLFRSLPGNRSVVRLAVTILDIGPGTLFKGPRLGLGDGSGVLNNRLVGLSVGQMHVTKLAEPLEIVFSHQRPPPNMTLTCVFWDVTKGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATAVKERGKNRKKVLTLLGLSSLVGVTWGLAIFTPLGLSTVYIFALFNSLQGVFICCWFTILYLPSQSTTVSSSTARLDQAHSASQE

SEQ ID NO: 10557 - protein, 429 aa, Artificial Sequence
  Description of Artificial Sequence: Synthetic coding sequence
MKDEDKPPDRVRLPKSLFRSLPGNRSVVRLAVTILDIGPGTLFKGPRLGLGDGSGVLNNRLVGLSVGQMHVTKLAEPLEIVFSHQRPPPNMTLTCVFWDVTKGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATAVKERGKNRKKVLTLLGLSSLVGVTWGLAIFTPLGLSTVYIFALFNSLQGVFICCWFTILYLPSQSTTVSSSTARLDQAHSASQE

SEQ ID NO: 10558 - protein, 357 aa, Artificial Sequence
  Description of Artificial Sequence: Synthetic coding sequence
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 10559 - protein, 274 aa, Artificial Sequence
  Description of Artificial Sequence: Synthetic coding sequence
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNP

SEQ ID NO: 10560 - protein, 926 aa, Artificial Sequence
  Description of Artificial Sequence: Synthetic coding sequence
MAFLIILITCFVIILATSQPCQTPDDFVAATSPGHIIIGGLFAIHEKMLSSEDSPRRPQIQECVGFEISVFLQTLAMIHSIEMINNSTLLPGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQVNVIVVFLRQFHVFDLFNKAIEMNINKMWIASDNWSTATKITTIPNVKKIGKVVGFAFRRGNISSFHSFLQNLHLLPSDSHKLLHEYAMHLSACAYVKDTDLSQCIFNHSQRTLAYKANKAIERNFVMRNDFLWDYAEPGLIHSIQLAVFALGYAIRDLCQARDCQNPNAFQPWELLGVLKNVTFTDGWNSFHFDAHGDLNTGYDVVLWKEINGHMTVTKMAEYDLQNDVFIIPDQETKNEFRNLKQIQSKCSKECSPGQMKKTTRSQHICCYECQNCPENHYTNQTDMPHCLLCNNKTHWAPVRSTMCFEKEVEYLNWNDSLAILLLILSLLGIIFVLVVGIIFTRNLNTPVVKSSGGLRVCYVILLCHFLNFASTSFFIGEPQDFTCKTRQTMFGVSFTLCISCILTKSLKILLAFSFDPKLQKFLKCLYRPILIIFTCTGIQVVICTLWLIFAAPTVEVNVSLPRVIILECEEGSILAFGTMLGYIAILAFICFIFAFKGKYENYNEAKFITFGMLIYFIAWITFIPIYATTFGKYVPAVEIIVILISNYGILYCTFIPKCYVIICKQEINTKSAFLKMIYSYSSHSVSSIALSPASLDSMSGNVTMTNPSSSGKSATWQKSKDLQAQAFAHICRENATSVSKTLPRKRMSSI

SEQ ID NO: 10561 - protein, 855 aa, Artificial Sequence
  Description of Artificial Sequence: Synthetic coding sequence
MAFLIILITCFVIILATSQPCQTPDDFVAATSPGHIIIGGLFAIHEKMLSSEDSPRRPQIQECVGFEISVFLQTLAMIHSIEMINNSTLLPGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQVNVIVVFLRQFHVFDLFNKAIEMNINKMWIASDNWSTATKITTIPNVKKIGKVVGFAFRRGNISSFHSFLQNLHLLPSDSHKLLHEYAMHLSACAYVKDTDLSQCIFNHSQRTLAYKANKAIERNFVMRNDFLWDYAEPGLIHSIQLAVFALGYAIRDLCQARDCQNPNAFQPWEQIQSKCSKECSPGQMKKTTRSQHICCYECQNCPENHYTNQTDMPHCLLCNNKTHWAPVRSTMCFEKEVEYLNWNDSLAILLLILSLLGIIFVLVVGIIFTRNLNTPVVKSSGGLRVCYVILLCHFLNFASTSFFIGEPQDFTCKTRQTMFGVSFTLCISCILTKSLKILLAFSFDPKLQKFLKCLYRPILIIFTCTGIQVVICTLWLIFAAPTVEVNVSLPRVIILECEEGSILAFGTMLGYIAILAFICFIFAFKGKYENYNEAKFITFGMLIYFIAWITFIPIYATTFGKYVPAVEIIVILISNYGILYCTFIPKCYVIICKQEINTKSAFLKMIYSYSSHSVSSIALSPASLDSMSGNVTMTNPSSSGKSATWQKSKDLQAQAFAHICRENATSVSKTLPRKRMSSI

SEQ ID NO: 10562 - protein, 751 aa, Artificial Sequence
  Description of Artificial Sequence: Synthetic coding sequence
MAFLIILITCFVIILATSQPCQTPDDFVAATSPGHIIIGGLFAIHEKMLSSEDSPRRPQIQECVGFEISVFLQTLAMIHSIEMINNSTLLPGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQLLGVLKNVTFTDGWNSFHFDAHGDLNTGYDVVLWKEINGHMTVTKMAEYDLQNDVFIIPDQETKNEFRNLKQIQSKCSKECSPGQMKKTTRSQHICCYECQNCPENHYTNQTDMPHCLLCNNKTHWAPVRSTMCFEKEVEYLNWNDSLAILLLILSLLGIIFVLVVGIIFTRNLNTPVVKSSGGLRVCYVILLCHFLNFASTSFFIGEPQDFTCKTRQTMFGVSFTLCISCILTKSLKILLAFSFDPKLQKFLKCLYRPILIIFTCTGIQVVICTLWLIFAAPTVEVNVSLPRVIILECEEGSILAFGTMLGYIAILAFICFIFAFKGKYENYNEAKFITFGMLIYFIAWITFIPIYATTFGKYVPAVEIIVILISNYGILYCTFIPKCYVIICKQEINTKSAFLKMIYSYSSHSVSSIALSPASLDSMSGNVTMTNPSSSGKSATWQKSKDLQAQAFAHICRENATSVSKTLPRKRMSSI

SEQ ID NO: 10563 - protein, 109 aa, Artificial Sequence
  Description of Artificial Sequence: Synthetic coding sequence
MKEEDSSFKLCVPGIVALQSPPNKAFRSTDTVGFLESELKKLLGMQQESRLWKLGSQEGRELLTRPEITVVEGEGYEVQRRLRHLPSPISVAQCLLLEEKGEMGNWPPE

SEQ ID NO: 10564 - protein, 961 aa, Artificial Sequence
  Description of Artificial Sequence: Synthetic coding sequence
MLLLLLLAPLFLRPPGAGGVQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 10565 - protein, 899 aa, Artificial Sequence
  Description of Artificial Sequence: Synthetic coding sequence
MLLLLLLAPLFLRPPGAGGVQTPNATSEGCQIIHPPWEGGIRYRGLTRDQVKAINFLPVDYEIEYVCRGEREVVGPKVRKCLANGSWTDMDTPSRCVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 10566 - protein, 844 aa, Artificial Sequence
  Description of Artificial Sequence: Synthetic coding sequence
MGPGAPFARVGWPLPLLVVMAAGVAPVWASHSPHLPRPHSRVPPHPSSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 10567 - protein, 844 aa, Artificial Sequence; identical to SEQ ID NO: 10566
  Description of Artificial Sequence: Synthetic coding sequence

SEQ ID NO: 10568 - protein, 578 aa, Artificial Sequence
  Description of Artificial Sequence: Synthetic coding sequence
MLLLLLLAPLFLRPPGAGGVQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIVISRTHSPT

SEQ ID NO: 10569 - protein, 662 aa, Artificial Sequence
  Description of Artificial Sequence: Synthetic coding sequence
MAAENEASQESALGAYSPVDYMSITSFPRLPEDEPAPAAPLRGRKDEDAFLGDPDTDPDSFLKSARLQRLPSSSSEMGSQDGSPLRETRKDPFSAAAAECSCRQDGLTVIVTACLTFATGVTVALVMQIYFGDPQIFQQGAVVTDAARCTSLGIEVLSKQGSSVDAAVAAALCLGIVAPHSSGLGGGGVMLVHDIRRNESHLIDFRESAPGALREETLQRSWETKPGLLVGVPGMVKGLHEAHQLYGRLPWSQVLAFAAAVAQDGFNVTHDLARALAEQLPPNMSERFRETFLPSGRPPLPGSLLHRPDLAEVLDVLGTSGPAAFYAGGNLTLEMVAEAQHAGGVITEEDFSNYSALVEKPVCGVYRGHLVLSPPPPHTGPALISALNILEGFNLTSLVSREQALHWVAETLKIALALASRLGDPVYDSTITESMDDMLSKVEAAYLRGHINDSQAAPAPLLPVYELDGAPTAAQVLIMGPDDFIVAMVSSLNQPFGSGLITPSGILLNSQMLDFSWPNRTANHSAPSLENSVQPGKRPLSFLLPTVVRPAEGLCGTYLALGANGAARGLSGLTQVLLNVLTLNRNLSDSLARGRLHPDLQSNLLQVDSEFTEEEIEFLEARGHHVEKVDVLSWVHGSRRTNNFIIAVKDPRSPDAAGATIL

SEQ ID NO: 10570 - protein, 394 aa, Artificial Sequence
  Description of Artificial Sequence: Synthetic coding sequence
MIVFIFLAMGLSLENEYTSQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGEVIYAAMCMTVTCGILLLVMVKLRTSRISSKARDPSSIQIPGEL

SEQ ID NO: 10571 - protein, 530 aa, Artificial Sequence
  Description of Artificial Sequence: Synthetic coding sequence
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 10572 - protein, 474 aa, Artificial Sequence
  Description of Artificial Sequence: Synthetic coding sequence
MLLWPLLLLLLLLPTLALLRQQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 10573 - protein, 474 aa, Artificial Sequence
  Description of Artificial Sequence: Synthetic coding sequence
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILEWGRTDRAEDTRLGSCPFTGSMCAHGVYSQIPLRALLPTTRCLWR

SEQ ID NO: 10574 - protein, 491 aa, Artificial Sequence
  Description of Artificial Sequence: Synthetic coding sequence
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 10575 - protein, 474 aa, Artificial Sequence; identical to SEQ ID NO: 10573
  Description of Artificial Sequence: Synthetic coding sequence

SEQ ID NO: 10576 - protein, 530 aa, Artificial Sequence; identical to SEQ ID NO: 10571
  Description of Artificial Sequence: Synthetic coding sequence

SEQ ID NO: 10577 - protein, 333 aa, Artificial Sequence
  Description of Artificial Sequence: Synthetic coding sequence
MPLGLGRRKKAPPLVENEEAEPGRGGLGVGEPGPLGGGGSGGPQMGLPPPPPALRPRLVFHTQLAHGSPTGRIEGFTNVKELYGKIAEAFRLPTAEVMFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAFDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 10578 - protein, 333 aa, Artificial Sequence; identical to SEQ ID NO: 10577
  Description of Artificial Sequence: Synthetic coding sequence

SEQ ID NO: 10579 - protein, 236 aa, Artificial Sequence
  Description of Artificial Sequence: Synthetic coding sequence
MFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAFDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 10580 - protein, 236 aa, Artificial Sequence; identical to SEQ ID NO: 10579
  Description of Artificial Sequence: Synthetic coding sequence

SEQ ID NO: 10581 - protein, 333 aa, Artificial Sequence; identical to SEQ ID NO: 10577
  Description of Artificial Sequence: Synthetic coding sequence

SEQ ID NO: 10582 - protein, 253 aa, Artificial Sequence
  Description of Artificial Sequence: Synthetic coding sequence
MEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSKIKKINMKKMHNGLDKKNKRLNTSFLWSC

SEQ ID NO: 10583 - protein, 106 aa, Artificial Sequence
  Description of Artificial Sequence: Synthetic coding sequence
MEAARPFAREWRAQSLPLAVGGVLKLRLCELWLLLLGSSLNARFLPDEEDVDFINEYVNLHNELRGDVIPRGSNLRFMLWYCCDSDGSRFIIGFPNLSPRTPSAPL

SEQ ID NO: 10584 - protein, 237 aa, Artificial Sequence
  Description of Artificial Sequence: Synthetic coding sequence
MVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSNADRDQATYYRFWYPKWEMPRPVVCDPLCTFILLLRILCFILCVITVLIVQSQFPNILLEQQMIFTPEESEAGNEEEEKEEEKKEKEEMEMEIMEMEEEKEEREEEEEETQKEKMEEEEK

SEQ ID NO: 10585 - protein, 168 aa, Artificial Sequence
  Description of Artificial Sequence: Synthetic coding sequence
MEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQRNTDEKTL

SEQ ID NO: 10586 - protein, 279 aa, Artificial Sequence
  Description of Artificial Sequence: Synthetic coding sequence
MLITMILHRARTKTWDVALSRTARAWGKKCLFTHNIYLQDVQMVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSNADRDQATYYRFWYPKWEMPRPVVCDPLCTFILLLRILCFILCVITVLIVQSQFPNILLEQQMIFTPEESEAGNEEEEKEEEKKEKEEMEMEIMEMEEEKEEREEEEEETQKEKMEEEEK

SEQ ID NO: 10587 - protein, 344 aa, Artificial Sequence
  Description of Artificial Sequence: Synthetic coding sequence
MEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSNADRDQATYYRFWYPKWEMPRPVVCDPLCTFILLLRILCFILCVITVLIVQSQFPNILLEQQMIFTPEESEAGNEEEEKEEEKKEKEEMEMEIMEMEEEKEEREEEEEETQKEKMEEEEK

SEQ ID NO: 10588 - protein, 184 aa, Artificial Sequence
  Description of Artificial Sequence: Synthetic coding sequence
MKPDETPMFDPSLLKEVDWSQNTATFSPAISPTHPGEGLVLRPLCTADLNRGFFKVLGQLTETGVVSPEQFMKSFEHMKKSGDYYVTVVEDVTLGQIVATATLIIEHKFIHSCAKRGRVEDVVVSDECRGKQLGKLLLSTLTLLSKKLNCYKITLECLPQNVGFYKKFGYTVSEENYMCRRFLK

SEQ ID NO: 10589 - protein, 163 aa, Artificial Sequence
  Description of Artificial Sequence: Synthetic coding sequence
MKPDETPMFDPSLLKEVDWSQNTATFSPAISPTHPGEGLVLRPLCTADLNRGFFKVLGQLTETGVVSPEQFMKSFEHMKKSGDYYVTVVEDVTLGQIVATATLIIEHKFIHSCAKRGRVEDVVVSDECRGKQLGKLLLSTLTLLSKKLNCYKITLECLPQNVG

SEQ ID NO: 10590 - protein, 453 aa, Artificial Sequence
  Description of Artificial Sequence: Synthetic coding sequence
MKIFKCYFKHTLQQKVFILFLTLWLLSLLKLLNVRRLFPQKDIYLVEYSLSTSPFVRNRYTHVKDEVRYEVNCSGIYEQEPLEIGKSLEIRRRDIIDLEDDDVVAMTSDCDIYQTLRGYAQKLVSKEEKSFPIAYSLVVHKDAIMVERLIHAIYNQHNIYCIHYDRKAPDTFKVAMNNLAKCFSNIFIASKLEAVEYAHISRLQADLNCLSDLLKSSIQWKYVINLCGQDFPLKSNFELVSELKKLNGANMLETVKPPNSKLERFTYHHELRRVPYEYVKLPIRTNISKEAPPHNIQIFVGSAYFVLSQAFVKYIFNNSIVQDFFAWSKDTYSPDEHFWATLIRVPGIPGEISRSAQDVSDLQSKTRLVKWNYYEGFFYPSCTGSHLRSVCIYGAAELRWLIKDGHWFANKFDSKVDPILIKCLAEKLEEQQRDWITLPSEKLFMDRNLTTTS

SEQ ID NO: 10591 - protein, 308 aa, Artificial Sequence
  Description of Artificial Sequence: Synthetic coding sequence
MFVQLLRAIYVPQNVYCIHVDEKAPMKYKTAVQTLVNCFENVFISSKTEKVAYAGFTRLQADINCMKVLVHSKFQWNYVINLCGQDFPIKTNREIIHYIRSKWSDKNITPGVIQPLHIKSKTSQSHLEFVPKGSIYAPPNNRFKDKPPHNLTIYFGSAYYVLTRKFVEFILTDIHAKDMLQWSKDIRSPEQHYWVTLNRLKDAPGATPNAGWEGNVRAIKRKSEEGNVHDGCKGRYVEDICVYGPGDLPWLIQSPSLFANKFEPSTDPLVVTCLERRHRLQVLRQAEVPIEPHWHFQQQSHFNMRLNR

SEQ ID NO: 10592 - protein, 172 aa, Artificial Sequence
  Description of Artificial Sequence: Synthetic coding sequence
MRDCCGMVSSGSLSSLKAAERTPGALFFSSSTPGRYYNYDSSSRPQSRSVMSDQCAGQWFLKACGLGEGDTEVFPTQHVVRALQTIFELNVQAFAGGAMGAVNGMQPHGVPDKSSVQSDEVWVGVVYGLAATMIQEVMHSFSHLSTICILAQKTSSTTKFLQGITQCHLVRL

SEQ ID NO: 10593 - protein, 877 aa, Artificial Sequence
  Description of Artificial Sequence: Synthetic coding sequence
MGTQDPGNMGTGVPASEQISCAKEDPQVYCPEETGGTKDVQVTDCKSPEDSRPPKETDCCNPEDSGQLMVSYEGKAMGYQVPPFGWRICLAHEFTEKRKPFQANNVSLSNMIKHIGMGLRYLQWWYRKTHVEKKTPFIDMINSVPLRQIYGCPLGGIGGGTITRGWRGQFCRWQLNPGMYQHRTVIADQFTVCLRREGQTVYQQVLSLERPSVLRSWNWGLCGYFAFYHALYPRAWTVYQLPGQNVTLTCRQITPILPHDYQDSSLPVGVFVWDVENEGDEALDVSIMFSMRNGLGGGDDAPGGLWNEPFCLERSGETVRGLLLHHPTLPNPYTMAVAARVTAATTVTHITAFDPDSTGQQVWQDLLQDGQLDSPTGQSTPTQKGVGIAGAVCVSSKLRPRGQCRLEFSLAWDMPRIMFGAKGQVHYRRYTRFFGQDGDAAPALSHYALCRYAEWEERISAWQSPVLDDRSLPAWYKSALFNELYFLADGGTVWLEVLEDSLPEELGRNMCHLRPTLRDYGRFGYLEGQEYRMYNTYDVHFYASFALIMLWPKLELSLQYDMALATLREDLTRRRYLMSGVMAPVKRRNVIPHDIGDPDDEPWLRVNAYLIHDTADWKDLNLKFVLQVYRDYYLTGDQNFLKDMWPVCLAVMESEMKFDKDHDGLIENGGYADQTYDGWVTTGPSAYCGGLWLAAVAVMVQMAALCGAQDIQDKFSSILSRGQEAYERLLWNGRYYNYDSSSRPQSRSVMSDQCAGQWFLKACGLGEGDTEVFPTQHVVRALQTIFELNVQAFAGGAMGAVNGMQPHGVPDKSSVQSDEVWVGVVYGLAATMIQELLPSGFCLWVIVISSTCWELLEGKDSTASIYPVEVALQRVPS

SEQ ID NO: 10594 - protein, 927 aa, Artificial Sequence
  Description of Artificial Sequence: Synthetic coding sequence
MGTQDPGNMGTGVPASEQISCAKEDPQVYCPEETGGTKDVQVTDCKSPEDSRPPKETDCCNPEDSGQLMVSYEGKAMGYQVPPFGWRICLAHEFTEKRKPFQANNVSLSNMIKHIGMGLRYLQWWYRKTHVEKKTPFIDMINSVPLRQIYGCPLGGIGGGTITRGWRGQFCRWQLNPGMYQHRTVIADQFTVCLRREGQTVYQQVLSLERPSVLRSWNWGLCGYFAFYHALYPRAWTVYQLPGQNVTLTCRQITPILPHDYQDSSLPVGVFVWDVENEGDEALDVSIMFSMRNGLGGGDDAPGGLWNEPFCLERSGETVRGLLLHHPTLPNPYTMAVAARVTAATTVTHITAFDPDSTGQQVWQDLLQDGQLDSPTGQSTPTQKGVGIAGAVCVSSKLRPRGQCRLEFSLAWDMPRIMFGAKGQVHYRRYTRFFGQDGDAAPALSHYALCRYAEWEERISAWQSPVLDDRSLPAWYKSALFNELYFLADGGTVWLEVLEDSLPEELGRNMCHLRPTLRDYGRFGYLEGQEYRMYNTYDVHFYASFALIMLWPKLELSLQYDMALATLREDLTRRRYLMSGVMAPVKRRNVIPHDIGDPDDEPWLRVNAYLIHDTADWKDLNLKFVLQVYRDYYLTGDQNFLKDMWPVCLAVMESEMKFDKDHDGLIENGGYADQTYDGWVTTGPSAYCGGLWLAAVAVMVQMAALCGAQDIQDKFSSILSRGQEAYERLLWNGRYYNYDSSSRPQSRSVMSDQCAGQWFLKACGLGEGDTEVFPTQHVVRALQTIFELNVQAFAGGAMGAVNGMQPHGVPDKSSVQSDEVWVGVVYGLAATMIQEGLTWEGFQTAEGCYRTVWERLGLAFQTPEAYCQQRVFRSLAYMRPLSIWAMQLALQQQQHKKASWPKVKQGTGLRTGPMFGPKEAMANLSPE

SEQ ID NO: 10595 - protein, 933 aa, Artificial Sequence
  Description of Artificial Sequence: Synthetic coding sequence
MGTQDPGNMGTGVPASEQISCAKEDPQVYCPEETGGTKDVQVTDCKSPEDSRPPKETDCCNPEDSGQLMVSYEGKAMGYQVPPFGWRICLAHEFTEKRKPFQANNVSLSNMIKHIGMGLRYLQWWYRKTHVEKKTPFIDMINSVPLRQIYGCPLGGIGGGTITRGWRGQFCRWQLNPGMYQHRTVIADQPICPLKFTVCLRREGQTVYQQVLSLERPSVLRSWNWGLCGYFAFYHALYPRAWTVYQLPGQNVTLTCRQITPILPHDYQDSSLPVGVFVWDVENEGDEALDVSIMFSMRNGLGGGDDAPGGLWNEPFCLERSGETVRGLLLHHPTLPNPYTMAVAARVTAATTVTHITAFDPDSTGQQVWQDLLQDGQLDSPTGQSTPTQKGVGIAGAVCVSSKLRPRGQCRLEFSLAWDMPRIMFGAKGQVHYRRYTRFFGQDGDAAPALSHYALCRYAEWEERISAWQSPVLDDRSLPAWYKSALFNELYFLADGGTVWLEVLEDSLPEELGRNMCHLRPTLRDYGRFGYLEGQEYRMYNTYDVHFYASFALIMLWPKLELSLQYDMALATLREDLTRRRYLMSGVMAPVKRRNVIPHDIGDPDDEPWLRVNAYLIHDTADWKDLNLKFVLQVYRDYYLTGDQNFLKDMWPVCLAVMESEMKFDKDHDGLIENGGYADQTYDGWVTTGPSAYCGGLWLAAVAVMVQMAALCGAQDIQDKFSSILSRGQEAYERLLWNGRYYNYDSSSRPQSRSVMSDQCAGQWFLKACGLGEGDTEVFPTQHVVRALQTIFELNVQAFAGGAMGAVNGMQPHGVPDKSSVQSDEVWVGVVYGLAATMIQEGLTWEGFQTAEGCYRTVWERLGLAFQTPEAYCQQRVFRSLAYMRPLSIWAMQLALQQQQHKKASWPKVKQGTGLRTGPMFGPKEAMANLSPE

SEQ ID NO: 10596 - protein, 1211 aa, Artificial Sequence
  Description of Artificial Sequence: Synthetic coding sequence
MATTATPATNQGWPEDFGFRLGGSGPCFVLEVAKGSSAHAGGLRPGDQILEVEGLAVGGLSRERLVRLARRCPRVPPSLGVLPAPDGGPGPGSGPAAPTTVLRAPRCGRGLALGRELLRLAGRKRPDAVHRERRRKAQEFSRKVDEILGDQPTAKEQVFAALKQFAAEQRVDDLVWTLTLALPREACGPLLDNLRIFIPKKHRARFDEVVSQGLLGKLCRARRAQGAQRLRRSRSEERPERLLVSTRASAPPRRPDEPPPRRASLLVGGLAGPGGARRTVRVYKGNKSFGFTLRGHGPVWIESVLPGSPADNAALKSGDRILFLNGLDMRNCSHDKVVSMLQGSGAMPTLVVEEGLVPFASDSDSLDSPNPSSALTSLQWVAEILPSSIRVQGRTFSQQLEHLLTPPERYGVCRALESFFQHRNIDTLIVDVYPVLDTPAKQVLWQFIYQLLTYEEQELCQEKIACFLGYTAMTAEPEPELDLESEPTPEPQPRSSLRASSMCRRSLRSQGLEAGLSCGPSECPEMPLPLIPGERQAGDGTSLPETPNPKMMSAVYAELESRLNSSFKGKMGTVSKSRASPPGPSPAVTTGPRTLSGVSWPSERLLPSPCYHPLCSGGLASPSSSESHPYASLDSSRAPSPQPGPGPICPDSPPSPDPTRPPSRRKLFTFSHPVRSRDTDRFLDVLSEQLGPRVTIVDDFLTPENDYEEMSFHDDQGSFVTNERSSASDCISSSEEGSSLTYSSISDHIPPPPLSPPPPPPLPFHDAKPSSRSSDGSRGPAQALAKPLTQLSHPVPPPPPPPLPPPVPCAPPMLSRGLGHRRSETSHMSVKRLRWEQVENSEGTIWGQLGEDSDYDKLSDMVKYLDLELHFGTQKPAKPVPGPEPFRKKEVVEILSHKKAYNTSILLAHLKLSPAELRQVLMSMEPRRLEPAHLAQLLLFAPDADEEQRYQAFREAPGRLSEPDQFVLQMLSVPEYKTRLRSLHFQATLQEKTEEIRGSLECLRQASLELKNSRKLAKILEFVLAMGNYLNDGQPKTNKTTGFKINFLTELNSTKTVDGKSTFLHILAKSLSQHFPELLGFAQDLPTVPLAAKVNQRALTSDLADLHGTISEIQDACQSISPSSEDKFAMVMSSFLETAQPALRALDGLQREAMEELGKALAFFGEDSKATTSEAFFGIFAEFMSKFERALSDLQAGEGLRSSGMVSPLAW

SEQ ID NO: 10597 - protein, 1043 aa, Artificial Sequence
  Description of Artificial Sequence: Synthetic coding sequence
MEFVRALWLGLALALGPGSAGGHPQPCGVLARLGGSVRLGALLPRAPLARARARAALARAALAPRLPHNLSLELVVAAPPARDPASLTRGLCQALVPPGVAALLAFPEARPELLQLHFLAAATETPVLSLLRREARAPLGAPNPFHLQLHWASPLETLLDVLVAVLQAHAWEDVGLALCRTQDPGGLVALWTSRAGRPPQLVLDLSRRDTGDAGLRARLAPMAAPVGGEAPVPAAVLLGCDIARARRVLEAVPPGPHWLLGTPLPPKALPTAGLPPGLLALGEVARPPLEAAIHDIVQLVARALGSAAQVQPKRALLPAPVNCGDLQPAGPESPGRFLARFLANTSFQGRTGPVWVTGSSQVHMSRHFKVWSLRRDPRGAPAWATVGSWRDGQLDLEPGGASARPPPPQGAQVWPKLRVVTLLEHPFVFARDPDEDGQCPAGQLCLDPGTNDSATLDALFAALANGSAPRALRKCCYGYCIDLLERLAEDTPFDFELYLVGDGKYGALRDGRWTGLVGDLLAGRAHMAVTSFSINSARSQVVDFTSPFFSTSLGIMVRARDTASPIGAFMWPLHWSTWLGVFAALHLTALFLTVYEWRSPYGLTPRGRNRSTVFSYSSALNLCYAILFRRTVSSKTPKCPTGRLLMNLWAIFCLLVLSSYTANLAAVMVGDKTFEELSGIHDPKLHHPAQGFRFGTVWESSAEAYIKKSFPDMHAHMRRHSAPTTPRGVAMLTSDPPKLNAFIMDKSLLDYEVSIDADCKLLTVGKPFAIEGYGIGLPQNSPLTSNLSEFISRYKSSGFIDLLHDKWYKMVPCGKRVFAVTETLQMSIYHFAGLFVLLCLGLGSALLSSLGEHAFFRLALPRIRKGSRLQYWLHTSQKIHRALNTEPPEGSKEETAEAEPSGPEVEQQQQQQDQPTAPEGWKRARRAVDKERRVRFLLEPAVVVAPEADAEAEAAPREGPVWLCSYGRPPAARPTGAPQPGELQELERRIEVARERLRQALVRRGQLLAQLGDSARHRPRRLLQARAAPAEAPPHSGRPGSQE

SEQ ID NO: 10598 - protein, 1180 aa, Artificial Sequence
  Description of Artificial Sequence: Synthetic coding sequence
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 10599 - protein, 1212 aa, Artificial Sequence
  Description of Artificial Sequence: Synthetic coding sequence
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPKGSMGNGGRATMSSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 10600 - protein, 942 aa, Artificial Sequence
  Description of Artificial Sequence: Synthetic coding sequence
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPPSPFRDSVDSGSTTPNSPVSESALCIPSSPKYDTLIIRDYTQSSSSL

SEQ ID NO: 10601 - protein, 1212 aa, Artificial Sequence; identical to SEQ ID NO: 10599
  Description of Artificial Sequence: Synthetic coding sequence

SEQ ID NO: 10602 - protein, 1180 aa, Artificial Sequence; identical to SEQ ID NO: 10598
  Description of Artificial Sequence: Synthetic coding sequence

SEQ ID NO: 10603 - protein, 382 aa, Artificial Sequence
  Description of Artificial Sequence: Synthetic coding sequence
MRSGGRGRPRLRLGERGLMEPLLPPKRRLLPRVRLLPLLLALAVGSAFYTIWSGWHRRTEELPLGRELRVPLIGSLPEARLRRVVGQLDPQRLWSTYLRPLLVVRTPGSPGNLQVRKFLEATLRSLTAGWHVELDPFTASTPLGPVDFGNVVATLDPRAARHLTLACHYDSKLFPPGSTPFVGATDSAVPCALLLELAQALDLELSRAKKQAAPVTLQLLFLDGEEALKEWGPKDSLYGSRHLAQLMESIPHSPGPTRIQAIELFMLLDLLGAPNPTFYSHFPRTVRWFHRLRSIEKRLHRLNLLQSHPQEVMYFQPGEPFGSVEDDHIPFLRRGVPVLHLISTPFPAVWHTPADTEVNLHPPTVHNLCRILAVFLAEYLGL

SEQ ID NO: 10604 - protein, 288 aa, Artificial Sequence
  Description of Artificial Sequence: Synthetic coding sequence
MRSGGRGRPRLRLGERGLMEPLLPPKRRLLPRVRLLPLLLALAVGSAFYTIWSGWHRRTEELPLGRELRVPLIGSLPEARLRRVVGQLDPQRLWSTYLRPLLVVRTPGSPGNLQVRKAAPVTLQLLFLDGEEALKEWGPKDSLYGSRHLAQLMESIPHSPGPTRIQAIELFMLLDLLGAPNPTFYSHFPRTVRWFHRLRSIEKRLHRLNLLQSHPQEVMYFQPGEPFGSVEDDHIPFLRRGVPVLHLISTPFPAVWHTPADTEVNLHPPTVHNLCRILAVFLAEYLGL

SEQ ID NO: 10605 - protein, 319 aa, Artificial Sequence
  Description of Artificial Sequence: Synthetic coding sequence
MLGRSLREVSAALKQGQITPTELCQKCLSLIKKTKFLNAYITVSEEVALKQAEESEKRYKNGQSLGDLDGIPIAVKDNFSTSGIETTCASNMLKGYIPPYNATVVQKLLDQGALLMGKTNLDEFAMGSGSTDGVFGPVKNPWSYSKQYREKRKQNPHSENEDSDWLITGGSSGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKVTFSFHYFTEILSSPIESTDLGGGLGGFESLLCHFY

SEQ ID NO: 10606 - protein, 528 aa, Artificial Sequence
  Description of Artificial Sequence: Synthetic coding sequence
MLGRSLREVSAALKQGQITPTELCQKCLSLIKKTKFLNAYITVSEEVALKQAEESEKRYKNGQSLGDLDGIPIAVKDNFSTSGIETTCASNMLKGYIPPYNATVVQKLLDQGALLMGKTNLDEFAMGSGSTDGVFGPVKNPWSYSKQYREKRKQNPHSENEDSDWLITGGSSGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKEYLVPELSSEVQSLWSKAADLFESEGAKVIEVSLPHTSYSIVCYHVLCTSEVASNMARFDGLQYGHRCDIDVSTEAMYAATRREGFNDVVRGRILSGNFFLLKENYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 10607 - protein, 136 aa, Artificial Sequence
  Description of Artificial Sequence: Synthetic coding sequence
MWSRLVWLGLRAPLGGRQGFTSKADPQGSGRITAAVIEHLERLALVDFGSREAVARLEKAIAFADRLRAVDTDGVEPMESVLEDRCLYLRSDNVVEGNCADELLQNSHRVVEEYFVAPPGNISLPKLDEQEPFPHS

SEQ ID NO: 10608 - protein, 209 aa, Artificial Sequence
  Description of Artificial Sequence: Synthetic coding sequence
MEPLAAYPLKCSGPRAKVFAVLLSIVLCTVTLFLLQLKFLKPKINSFYAFEVKDAKGRTVSLEKYKGKVSLVVNVASDCQLTDRNYLGLKELHKEFGPSHFSVLAFPCNQFGESEPRPSKEVESFARKNYGVTFPIFHKIKILGSEGEPAFRFLVDSSKKEPRWNFWKYLVNPEGQVVKFWKPEEPIEVIRPDIAALVRQVIIKKKEDL

SEQ ID NO: 10609 - protein, 795 aa, Artificial Sequence
  Description of Artificial Sequence: Synthetic coding sequence
MATMLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPPCQDVPQKIMESTGVQNLLSGRVPGGTGEGQVPDLVKKEVQRILGHIQAPPRPFLVRLFSWALLRFLNCLFLNVQLHKGQMKMVQKAAQAGLPLVLLSTHKTLLDGILLPFMLLSQGLGVLRVAWDSRACSPALRALLRKLGGLFLPPEASLSLDSSEGLLARAVVQAVIEQLLVSGQPLLIFLEEPPGALGPRLSALGQAWVGFVVQAVQVGIVPDALLVPVAVTYDLVPDAPCDIDHASAPLGLWTGALAVLRSLWSRWGCSHRICSRVHLAQPFSLQEYIVSARSCWGGRQTLEQLLQPIVLGQCTAVPDTEKEQEWTPITGPLLALKEEDQLLVRRLSCHVLSASVGSSAVMSTAIMATLLLFKHQKLLGEFSWLTEEILLRGFDVGFSGQLRSLLQHSLSLLRAHVALLRIRQGDLLVVPQPGPGLTHLAQLSAELLPVFLSEAVGACAVRGLLAGRVPPQGPWELQGILLLSQNELYRQILLLMHLLPQDLLLLKPCQSSYCYCQEVLDRLIQCGLLVAEETPGSRPACDTGRQRLSRKLLWKPSGDFTDSDSDDFGEADGRYFRLSQQSHCPDFFLFLCRLLSPLLKAFAQAAAFLRQGQLPDTELGYTEQLFQFLQATAQEEGIFECADPKLAISAVWTFRDLGVLQQTPSPAGPRLHLSPTFASLDNQEKLEQFIRQFICS

SEQ ID NO: 10610 - protein, 671 aa, Artificial Sequence
  Description of Artificial Sequence: Synthetic coding sequence
MATMLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPPCQDVPQKIMESTGVQNLLSGRVPGGTGEGQVPDLVKKEVQRILGHIQAPPRPFLVRLFSWALLRFLNCLFLNVQLHKGQMKMVQKAAQAGLPLVLLSTHKTLLDGILLPFMLLSQGLGVLRVAWDSRACSPALRALLRKLGGLFLPPEASLSLDSSEGLLARAVVQAVIEQLLVSGQPLLIFLEEPPGALGPRLSALGQAWVGFVVQAVQVGIVPDALLVPVAVTYDLVPDAPCDIDHASAPLGLWTGALAVLRSLWSRWGCSHRICSRVHLAQPFSLQEYIVSARSCWGGRQTLEQLLQPIVLGQCTAVPDTEKEQEWTPITGPLLALKEEDQLLVRRLSCHVLSASVGSSAVMSTAIMATLLLFKHQKLLGEFSWLTEEILLRGFDVGFSGQLRSLLQHSLSLLRAHVALLRIRQGDLLVVPQPGPGLTHLAQLSAELLPVFLSEAVGACAVRGLLAGRVPPQGPWELQGILLLSQNELYRQILLLMHLLPQDLLLLKPCQSSYCYCQEVLDRLIQCGLLVAEESWATQSSCSSSCRPPPRKKGSSSVRTQSSPSVLSGPSET

SEQ ID NO: 10611 - protein, 795 aa, Artificial Sequence; identical to SEQ ID NO: 10609
  Description of Artificial Sequence: Synthetic coding sequence

SEQ ID NO: 10612 - protein, 160 aa, Artificial Sequence
  Description of Artificial Sequence: Synthetic coding sequence
MATMLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPPCQDVPQKIMESTGVQNLLSGRVPGGTGEGQVPDLVKKEVQRILGHIQAPPRPFL

SEQ ID NO: 10613 - protein, 828 aa, Artificial Sequence
  Description of Artificial Sequence: Synthetic coding sequence
MDESALTLGTIDVSYLPHSSEYSVGRCKHTSEEWGECGFRPTIFRSATLKWKESLMSRKRPFVGRCCYSCTPQSWDKFFNPSIPSLGLRNVIYINETHTRHRGWLARRLSYVLFIQERDVHKGMFATNVTENVLNSSRVQEAIAEVAAELNPDGSAQQQSKAVNKVKKKAKRILQEMVATVSPAMIRLTGWVLLKLFNSFFWNIQIHKGQLEMVKAATETNLPLLFLPVHRSHIDYLLLTFILFCHNIKAPYIASGNNLNIPIFSTLIHKLGGFFIRRRLDETPDGRKDVLYRALLHGHIVELLRQQQFLEIFLEGTRSRSGKTSCARAGLLSVVVDTLSTNVIPDILIIPVGISYDRIIEGHYNGEQLGKPKKNESLWSVARGVIRMLRKNYGCVRVDFAQPFSLKEYLESQSQKPVSALLSLEQALLPAILPSRPSDAADEGRDTSINESRNATDESLRRRLIANLAEHILFTASKSCAIMSTHIVACLLLYRHRQGIDLSTLVEDFFVMKEEVLARDFDLGFSGNSEDVVMHAIQLLGNCVTITHTSRNDEFFITPSTTVPSVFELNFYSNGVLHVFIMEAIIACSLYAVLNKRGLGGPTSTPPNLISQEQLVRKAASLCYLLSNEGTISLPCQTFYQVCHETVGKFIQYGILTVAEHDDQEDISPSLAEQQWDKKLPEPLSWRSDEEDEDSDFGEEQRDCYLKVSQSKEHQQFITFLQRLLGPLLEAYSSAAIFVHNFSGPVPEPEYLQKLHKYLITRTERNVAVYAESATYCLVKNAVKMFKDIGVFKETKQKRVSVLELSSTFLPQCNRQKLLEYILSFVVL

SEQ ID NO: 10614 - protein, 710 aa, Artificial Sequence
  Description of Artificial Sequence: Synthetic coding sequence
MDESALTLGTIDVSYLPHSSEYSVGRCKHTSEEWGECGFRPTIFRSATLKWKESLMSRKRPFVGRCCYSCTPQSWDKFFNPSIPSLGLRNVIYINETHTRHRGWLARRLSYVLFIQERDVHKGMFATNVTENVLNSSRVQEAIAEVAAELNPDGSAQQQSKAVNKVKKKAKRILQEMVATVSPAMIRLTGWVLLKLFNSFFWNIQIHKGQLEMVKAATETNLPLLFLPVHRSHIDYLLLTFILFCHNIKAPYIASGNNLNIPIFSTLIHKLGGFFIRRRLDETPDGRKDVLYRALLHGHIVELLRQQQFLEIFLEGTRSRSGKTSCARAGLLSVVVDTLSTNVIPDILIIPVGISYDRIIEGHYNGEQLGKPKKNESLWSVARGVIRMLRKNYGCVRVDFAQPFSLKEYLESQSQKPVSALLSLEQALLPAILPSRPSDAADEGRDTSINESRNATDESLRRRLIANLAEHILFTASKSCAIMSTHIVACLLLYRHRQGIDLSTLVEDFFVMKEEVLARDFDLGFSGNSEDVVMHAIQLLGNCVTITHTSRNDEFFITPSTTVPSVFELNFYSNGVLHVFIMEAIIACSLYAVLNKRGLGGPTSTPPNLISQEQLVRKAASLCYLLSNEGTISLPCQTFYQVCHETVGKFIQYGILTVAEHDDQEDISPSLAEQQWDKKLPEPLSWRSDEEDEDSDFGEEQRDCYLKVLG

SEQ ID NO: 10615 - protein, 828 aa, Artificial Sequence; identical to SEQ ID NO: 10613
  Description of Artificial Sequence: Synthetic coding sequence

SEQ ID NO: 10616 - protein, 314 aa, Artificial Sequence
  Description of Artificial Sequence: Synthetic coding sequence
MSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRACQCEGKDNRIPLLKEVFEAFPNTPINIDIKVNNNVLIKKVSELVKRYNREHLTVWGNANYEIVEKCYKENSDIPILFSLQRVLLILGLFFTGLLPFVPIREQFFEIPMPSIILKLKEPHTMSRSQKFLIWLSDLLLMRKALFDHLTARGIQVYIWVLNEEQEYKRAFDLGATGVMTDYPTKLRDFLHNFSA

SEQ ID NO: 10617 - protein, 289 aa, Artificial Sequence
  Description of Artificial Sequence: Synthetic coding sequence
MSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRACQCEGKDNRIPLLKEVFEAFPNTPINIDIKVNNNVLIKKVSELVKRYNREHLTVWGNANYEIVEKCYKENSDIPILFSLQRVLLILGLFFTGLLPFVPIREQFFEIPMPSIILKLKEPHTMSRSQKFLIWLSDLLLMRKALFEPLHPASKRNFEGHCSYLVVSCYF

SEQ ID NO: 10618 - protein, 290 aa, Artificial Sequence
  Description of Artificial Sequence: Synthetic coding sequence
MSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRACQCEGKDNRIPLLKEVFEAFPNTPINIDIKVNNNVLIKKVSELVKRYNREHLTVWGNANYEIVEKCYKENSDIPILFSLQRVLLILGLFFTGLLPFVPIREQFFEIPMPSIILKLKEPHTMSRSQKFLIWLSDLLLMRKALFDHLTARGIQVSFWNDAFWKQHSSPV

SEQ ID NO: 10619 - protein, 539 aa, Artificial Sequence
  Description of Artificial Sequence: Synthetic coding sequence
MAESPGCCSVWARCLHCLYSCHWRKCPRERMQTSKCDCIWFGLLFLTFLLSLSWLYIGLVLLNDLHNFNEFLFRRWGHWMDWSLAFLLVISLLVTYASLLLVLALLLRLCRQPLHLHSLHKVLLLLIMLLVAAGLVGLDIQWQQEWHSLRVSLQATAPFLHIGAAAGIALLAWPVADTFYRIHRRGPKILLLLLFFGVVLVIYLAPLCISSPCIMEPRDLPPKPGLVGHRGAPMLAPENTLMSLRKTAECGATVFETDVMVSSDGVPFLMHDEHLSRTTNVASVFPTRITAHSSDFSWTELKRLNAGSWFLERRPFWGAKPLAGPDQKEAESQTVPALEELLEEAAALNLSIMFDLRRPPQNHTYYDTFVIQTLETVLNARVPQAMVFWLPDEDRANVQRRAPGMRQIYGRQGGNRTERPQFLNLPYQDLPLLDIKALHKDNVSVNLFVVNKPWLFSLLWCAGVDSVTTNDCQLLQQMRYPIWLITPQTYLIIWVITNCVSTMLLLWTFLLQRRFVKKRGKTGLETAVLLTRINNFMME

SEQ ID NO: 10620 - protein, 590 aa, Artificial Sequence
  Description of Artificial Sequence: Synthetic coding sequence
MAESPGCCSVWARCLHCLYSCHWRKCPRERMQTSKCDCIWFGLLFLTFLLSLSWLYIGLVLLNDLHNFNEFLFRRWGHWMDWSLAFLLVISLLVTYASLLLVLALLLRLCRQPLHLHSLHKVLLLLIMLLVAAGLVGLDIQWQQEWHSLRVSLQATAPFLHIGAAAGIALLAWPVADTFYRIHRRGPKILLLLLFFGVVLVIYLAPLCISSPCIMEPRDLPPKPGLVGHRGAPMLAPENTLMSLRKTAECGATVFETDVMVSSDGVPFLMHDEHLSRTTNVASVFPTRITAHSSDFSWTELKRLNAGSWFLERRPFWGAKPLAGPDQKEAESQTVPALEELLEEAAALNLSIMFDLRRPPQNHTYYDTFVIQTLETVLNARVPQAMVFWLPDEDRANVQRRAPGMRQIYGRQGGNRTERPQFLNLPYQDLPLLDIKDRFLLPAQAGLKLLASSNLPASASQSAGITGLSHCPPQPPGYKHELSHLAMALHKDNVSVNLFVVNKPWLFSLLWCAGVDSVTTNDCQLLQQMRYPIWLITPQTYLIIWVITNCVSTMLLLWTFLLQRRFVKKRGKTGLETAVLLTRINNFMME

SEQ ID NO: 10621 - protein, 460 aa, Artificial Sequence
  Description of Artificial Sequence: Synthetic coding sequence
MDWSLAFLLVISLLVTYASLLLVLALLLRLCRQPLHLHSLHKVLLLLIMLLVAAGLVGLDIQWQQEWHSLRVSLQATAPFLHIGAAAGIALLAWPVADTFYRIHRRGPKILLLLLFFGVVLVIYLAPLCISSPCIMEPRDLPPKPGLVGHRGAPMLAPENTLMSLRKTAECGATVFETDVMVSSDGVPFLMHDEHLSRTTNVASVFPTRITAHSSDFSWTELKRLNAGSWFLERRPFWGAKPLAGPDQKEAESQTVPALEELLEEAAALNLSIMFDLRRPPQNHTYYDTFVIQTLETVLNARVPQAMVFWLPDEDRANVQRRAPGMRQIYGRQGGNRTERPQFLNLPYQDLPLLDIKALHKDNVSVNLFVVNKPWLFSLLWCAGVDSVTTNDCQLLQQMRYPIWLITPQTYLIIWVITNCVSTMLLLWTFLLQRRFVKKRGKTGLETAVLLTRINNFMME

SEQ ID NO: 10622 - protein, 460 aa, Artificial Sequence; identical to SEQ ID NO: 10621
  Description of Artificial Sequence: Synthetic coding sequence

SEQ ID NO: 10623 - protein, 256 aa, Artificial Sequence
  Description of Artificial Sequence: Synthetic coding sequence
MAQRSDLLELDCQLTRDRVVVVSHDENLCRQSGLNRDVGSLDFEDLPLYKEKLEVYFSPGHFAHGSDRRMVRLEDLFQRFPRTPMSVEIKGKNEELIREIAGLVRRYDRNEITIWASEKSSVMKKCKAANPEMPLSFTISRGFWVLLSYYLGLLPFIPIPEKFFFCFLPNIINRTYFPFSCSCLNQLLAVVSKWLIMRKSLIRHLEERGVQVVFWCLNEESDFEAAFSVGATGVITDYPTALRHYLDNHGPAARTS

SEQ ID NO: 10624 - protein, 318 aa, Artificial Sequence
  Description of Artificial Sequence: Synthetic coding sequence
MSLLLYYALPALGSYAMLSIFFLRRPHLLHTPRAPTFRIRLGAHRGGSGELLENTMEAMENSMAQRSDLLELDCQLTRDRVVVVSHDENLCRQSGLNRDVGSLDFEDLPLYKEKLEVYFSPGHFAHGSDRRMVRLEDLFQRFPRTPMSVEIKGKNEELIREIAGLVRRYDRNEITIWASEKSSVMKKCKAANPEMPLSFTISRGFWVLLSYYLGLLPFIPIPEKFFFCFLPNIINRTYFPFSCSCLNQLLAVVSKWLIMRKSLIRHLEERGVQVVFWCLNEESDFEAAFSVGATGVITDYPTALRHYLDNHGPAARTS

SEQ ID NO: 10625 - protein, 520 aa, Artificial Sequence
  Description of Artificial Sequence: Synthetic coding sequence
MLLFLWIETSSEYFNFDWVTFLGTGYWFFWSIFILSLARILTAYSSLLLLLGFLLLWERIELYLHLCHKILILLVILLCVILMFIICKFWKERWLVAGLSMQIFAPYVHLVSITVMVILFWPVAFYVACLEREVRMRRYRMTHSEKKRLKQCNVITRLRGLQVPVGLPFLLILLGLYLMPLGIYSPCIQEKENLGPKPTIFGHRGAPMLGPENTMMSFEKAVEHGAHGLETDIHLSYDHVPFLMHDFDLKRTTNIGEVQPESACENPAFFNWDFLSTLNAGKWFVKPELRPFYNMKPLSEADKERARNQSIPTLADLLTLAEKERKFVIFDLHRPPPKHPLRHTFVRQVVSVILASKIEQHLIFWLPAHDRQYVRSVAPGFQHVGRLVSIETLAKNNISIINVDYKKLFPNGLRDYKAANIHINVYTVNEPWLFSLAWCSRINSVTTDNIGLLSQLDHPHFFMTPKFYVFMWLLADIISVLFIVAIFCFHWRRETEKEKLFETSSTRTDTQSGSKNEEDR

SEQ ID NO: 10626 - protein, 623 aa, Artificial Sequence
  Description of Artificial Sequence: Synthetic coding sequence
MLLFLWIETSSEYFNFDWVTFLGTGYWFFWSIFILSLARILTAYSSLLLLLGFLLLWERIELYLHLCHKILILLVILLCVILMFIICKFWKERWLVAGLSMQIFAPYVHLVSITVMVILFWPVAFYVACLEREVRMRRYRMTHSEKKRLKQCNVITRLRGLQVPVGLPFLLILLGLYLMPLGIYSPCIQEKENLGPKPTIFGHRGAPMLGPENTMMSFEKAVEHGAHGLETDIHLSYDHVPFLMHDFDLKRTTNIGEVQPESACENPAFFNWDFLSTLNAGKWFVKPELRPFYNMKPLSEADKERARNQSIPTLADLLTLAEKERKFVIFDLHRPPPKHPLRHTFVRQVVSVILASKIEQHLIFWLPAHDRQYVRSVAPGFQHVGRLVSIETLAKNNISIINVDYKKLFPNGLRDYKAANIHINVYTVNEPWLFSLAWCSRINSVTTDNIGLLSQLDHPHFFMTPKFYVFMWLLADIISVLFIVAIFCFHWRRETEKEKLFETSSTRTDTQSGNLHIAMKPPVRVVEGPWTLAALYPALPKSGKEHQGHFNFAAPSKKLLPIKNAVTPLKPGKHEIQPPMPTVVFELTQAPTRQATSEATFQTTLPTLKVDKPTMPSIEVPYP

SEQ ID NO: 10627 - protein, 417 aa, Artificial Sequence
  Description of Artificial Sequence: Synthetic coding sequence
MTTLVPATLSFLLLWTLPGQVLLRVALAKEEVKSGTKGSQPMSPSDFLDKLMGRTSGYDARIRPNFKGPPVNVTCNIFINSFSSITKTTMDYRVNVFLRQQWNDPRLSYREYPDDSLDLDPSMLDSIWKPDLFFANEKGANFHEVTTDNKLLRIFKNGNVLYSIRLTLILSCLMDLKNFPMDIQTCTMQLESFGYTMKDLVFEWLEDAPAVQVAEGLTLPQFILRDEKDLGCCTKHYNTGKFTCIEVKFHLERQMGYYLIQMYIPSLLIVILSWVSFWINMDAAPARVGLGITTVLTMTTQSSGSRASLPKVSYVKAIDIWMAVCLLFVFAALLEYAAINFVSRQHKEFIRLRRRQRRQRLEEDIIQESRFYFRGYGLGHCLQARDGGPMEGSGIYSPQPPAPLLREGETTRKLYVD

SEQ ID NO: 10628 - protein, 333 aa, Artificial Sequence
  Description of Artificial Sequence: Synthetic coding sequence
MFKLCSNKMVSQEGSEVELLVSPGARSEHGRYLQDPIVSIDLSEWLRIIEFLLQGLKVYGSVYHINHGNPFNMEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 10629 - protein, 302 aa, Artificial Sequence
  Description of Artificial Sequence: Synthetic coding sequence
MILLNNSHKLLALYKSLARSIPESLKVYGSVYHINHGNPFNMEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 10630 - protein, 279 aa, Artificial Sequence
  Description of Artificial Sequence: Synthetic coding sequence
MILLNNSHKLLALYKSLARSIPESLKVYGSVYHINHGNPFNMEVLVDSWPEYQMVIIRPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 10631 - protein, 68 aa, Artificial Sequence
  Description of Artificial Sequence: Synthetic coding sequence
MILLNNSHKLLALYKSLARSIPESLKVYGSVYHINHGNPFNMEVLVDSWPEYQMVIIRPQKQEMTDDM

SEQ ID NO: 10632 - protein, 79 aa, Artificial Sequence
  Description of Artificial Sequence: Synthetic coding sequence
MILLNNSHKLLALYKSLARSIPESLKVYGSVYHINHGNPFNMEVLVDSWPEYQMVIIRPQKQEMTDDMDSYTNVYRMFS

SEQ ID NO: 10633 - protein, 294 aa, Artificial Sequence
  Description of Artificial Sequence: Synthetic coding sequence
MLVLHNSQKLQILYKSLEKSIPESIKVYGAIFNIKDKNPFNMEVLVDAWPDYQIVITRPQKQEMKDDQDHYTNTYHIFTKAPDKLEEVLSYSNVISWEQTLQIQGCQEGLDEAIRKVATSKSVQVDYMKTILFIPELPKKHKTSSNDKMELFEVDDDNKEGNFSNMFLDASHAGLVNEHWAFGKNERSLKYIERCLQDFLGFGVLGPEGQLVSWIVMEQSCELRMGYTVPKYRHQGNMLQIGYHLEKYLSQKEIPFYFHVADNNEKSLQALNNLGFKICPCGWHQWKCTPKKYC

SEQ ID NO: 10634 - protein, 294 aa, Artificial Sequence; identical to SEQ ID NO: 10633
  Description of Artificial Sequence: Synthetic coding sequence

SEQ ID NO: 10635 - protein, 288 aa, Artificial Sequence
  Description of Artificial Sequence: Synthetic coding sequence
MLVLNCSTKLLILEKMLKSCFPESLKVYGAVMNINRGNPFQKEVVLDSWPDFKAVITRRQREAETDNLDHYTNAYAVFYKDVRAYRQLLEECDVFNWDQVFQIQGLQSELYDVSKAVANSKQLNIKLTSFKAVHFSPVSSLPDTSFLKGPSPRLTYLSVANADLLNRTWSRGGNEQCLRYIANLISCFPSVCVRDEKGNPVSWSITDQFATMCHGYTLPEHRRKGYSRLVALTLARKLQSRGFPSQGNVLDDNTASISLLKSLHAEFLPCRFHRLILTPATFSGLPHL

SEQ ID NO: 10636 - protein, 156 aa, Artificial Sequence
  Description of Artificial Sequence: Synthetic coding sequence
MLVLNCSTKLLILEKMLKSCFPESLKVYGAVMNINRGNPFQKEVVLDSWPDFKAVITRRQREAETDNLDHYTNAYAVFYKDVRAYRQLLEECDVFNWDQVFQIQGLQSELYDVSKAVANSKQLNIKLTSFKAVHFSPVSSLPDTSFLKGPSPRLTY

SEQ ID NO: 10637 - protein, 560 aa, Artificial Sequence
  Description of Artificial Sequence: Synthetic coding sequence
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 10638 - protein, 572 aa, Artificial Sequence
  Description of Artificial Sequence: Synthetic coding sequence
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 10639 - protein, 206 aa, Artificial Sequence
  Description of Artificial Sequence: Synthetic coding sequence
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGWLLQTPKLLLYLSLKFQPSLFLLYN

SEQ ID NO: 10640 - protein, 455 aa, Artificial Sequence
  Description of Artificial Sequence: Synthetic coding sequence
MECLYYFLGFLLLAARLPLDAAKRFHDVLGNERPSAYMREHNQLNGWSSDENDWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 10641 - protein, 607 aa, Artificial Sequence
  Description of Artificial Sequence: Synthetic coding sequence
MILPEALYLIKIEREAPQMPEEHCCSWWTGPEEFSMECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 10642 - protein, 514 aa, Artificial Sequence
  Description of Artificial Sequence: Synthetic coding sequence
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 10643 - protein, 461 aa, Artificial Sequence
  Description of Artificial Sequence: Synthetic coding sequence
MECLYYFLGFLLLAARLPLDAAKQAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 10644 - protein, 319 aa, Artificial Sequence
  Description of Artificial Sequence: Synthetic coding sequence
MVGKMWPVLWTLCAVRVTVDAISVETPQDVLRASQGKSVTLPCTYHTSTSSREGLIQWDKLLLTHTERVVIWPFSNKNYIHGELYKNRVSISNNAEQSDASITIDQLTMADNGTYECSVSLMSDLEGNTKSRVRLLVLVPPSKPECGIEGETIIGNNIQLTCQSKEGSPTPQYSWKRYNILNQEQPLAQPASGQPVSLKNISTDTSGYYICTSSNEEGTQFCNITVAVRSPSMNVALYVGIAVGVVAALIIIGIIIYCCCCRGKDDNTEDKEDARPNREAYEEPPEQLRELSREREEEDDYRQEEQRSTGRESPDHLDQ

SEQ ID NO: 10645 - protein, 560 aa, Artificial Sequence
  Description of Artificial Sequence: Synthetic coding sequence
MLRGTLLCAVLGLLRAQPFPCPPACKCVFRDAAQCSGGDVARISALGLPTNLTHILLFGMGRGVLQSQSFSGMTVLQRLMISDSHISAVAPGTFSDLIKLKTLRLSRNKITHLPGALLDKMVLLEQLFLDHNALRGIDQNMFQKLVNLQELALNQNQLDFLPASLFTNLENLKLLDLSGNNLTHLPKGLLGAQAKLERLLLHSNRLVSLDSGLLNSLGALTELQFHRNHIRSIAPGAFDRLPNLSSLTLSRNHLAFLPSALFLHSHNLTLLTLFENPLAELPGVLFGEMGGLQELWLNRTQLRTLPAAAFRNLSRLRYLGVTLSPRLSALPQGAFQGLGELQVLALHSNGLTALPDGLLRGLGKLRQVSLRRNRLRALPRALFRNLSSLESVQLDHNQLETLPGDVFGALPRLTEVLLGHNSWRCDCGLGPFLGWLRQHLGLVGGEEPPRCAGPGAHAGLPLWALPGGDAECPGPRGPPPRPAADSSSEAPVHPALAPNSSEPWVWAQPVTTGKGQDHSPFWGFYFLLLAVQAMITVIIVFAMIKIGQLFRKLIRERALG

SEQ ID NO: 10646 - protein, 560 aa, Artificial Sequence; identical to SEQ ID NO: 10645
  Description of Artificial Sequence: Synthetic coding sequence

SEQ ID NO: 10647 - protein, 622 aa, Artificial Sequence
  Description of Artificial Sequence: Synthetic coding sequence
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYVISLQGARKLLAAEPLSKMLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 10648 - protein, 233 aa, Artificial Sequence
  Description of Artificial Sequence: Synthetic coding sequence
MVHSTFLIDLRKAASRNLAFYPPHPDYTWSFDDIIVFAFSCKQAVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTVLPGMNSEG

SEQ ID NO: 10649 - protein, 626 aa, Artificial Sequence
  Description of Artificial Sequence: Synthetic coding sequence
MAARPAATLAWSLLLLSSALLREGCRARFVAERDSEDDGEEPVVFPESPLQSPTVLVAVLARNAAHTLPHFLGCLERLDYPKSRMAIWAATDHNVDNTTEIFREWLKNVQRLYHYVEWRPMDEPESYPDEIGPKHWPTSRFAHVMKLRQAALRTAREKWSDYILFIDVDNFLTNPQTLNLLIAENKTIVAPMLESRGLYSNFWCGITPKGFYKRTPDYVQIREWKRTGCFPVPMVHSTFLIDLRKEASDKLTFYPPHQDYTWTFDDIIVFAFSSRQAGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 10650 - protein, 363 aa, Artificial Sequence
  Description of Artificial Sequence: Synthetic coding sequence
MFSDCWLCPSLGSSGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 10651 - protein, 234 aa, Artificial Sequence
  Description of Artificial Sequence: Synthetic coding sequence
MLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 10652 - protein, 554 aa, Artificial Sequence
  Description of Artificial Sequence: Synthetic coding sequence
MAARPAATLAWSLLLLSSALLREGCRARFVAERDSEDDGEEPVVFPESPLQSPTVLVAVLARNAAHTLPHFLGCLERLDYPKSRMAIWAATDHNVDNTTEIFREWLKNVQRLYHYVEWRPMDEPESYPDEIGPKHWPTSRFAHVMKLRQAALRTAREKWSDYILFIDVDNFLTNPQTLNLLIAENKTIVAPMLESRGLYSNFWCGITPKGFYKRTPDYVQIREWKRTGCFPVPMVHSTFLIDLRKEASDKLTFYPPHQDYTWTFDDIIVFAFSSRQAGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVLLSSPHCHLFQTLSDDCQR

SEQ ID NO: 10653 - protein, 349 aa, Artificial Sequence
  Description of Artificial Sequence: Synthetic coding sequence
MALLRKINQVLLFLLIVTLCVILYKKVHKGTVPKNDADDESETPEELEEEIPVVICAAAGRMGATMAAINSIYSNTDANILFYVVGLRNTLTRIRKWIEHSKLREINFKIVEFNPMVLKGKIRPDSSRPELLQPLNFVRFYLPLLIHQHEKVIYLDDDVIVQGDIQELYDTTLALGHAAAFSDDCDLPSAQDINRLVGLQNTYMGYLDYRKKAIKDLGISPSTCSFNPGVIVANMTEWKHQRITKQLEKWMQKNVEENLYSSSLGGGVATSPMLIVFHGKYSTINPLWHIRHLGWNPDARYSEHFLQEAKLLHWNGRHKPWDFPSVHNDLWESWFVPDPAGIFKLNHHS

SEQ ID NO: 10654 - protein, 349 aa, Artificial Sequence; identical to SEQ ID NO: 10653
  Description of Artificial Sequence: Synthetic coding sequence

SEQ ID NO: 10655 - protein, 349 aa, Artificial Sequence; identical to SEQ ID NO: 10653
  Description of Artificial Sequence: Synthetic coding sequence

SEQ ID NO: 10656 - protein, 313 aa, Artificial Sequence
  Description of Artificial Sequence: Synthetic coding sequence
MAARRALHFVFKVGNRFQTARFYRDVLGMKVESCSVARLECSGAISAHCSDYTRITEDSFSKPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 10657 - protein, 298 aa, Artificial Sequence
  Description of Artificial Sequence: Synthetic coding sequence
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 10658 - protein, 501 aa, Artificial Sequence
  Description of Artificial Sequence: Synthetic coding sequence
MRLTPFSLSTGNSFRYSRRLKKNIFGTAPALRASEMSLRPSSRIFPCFSRNGLDFTIVITLLQPPVPGISFIVAKPRLFPGAGSAGCGLLERLFLSLLLGTGLRWCRGCFPGARFCSTTSPEGNTTFTGLRRSARTQRLQGPKPGPPAATVARQTSRVSPAPPCSLRPGLRHESAPSAASDVTARGALRGLGCTVRVTAACGGNHGCSQLHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 10659 - protein, 289 aa, Artificial Sequence
  Description of Artificial Sequence: Synthetic coding sequence
MRNLKKAAKLPVMGMIPCFLKSPLGSDYTRITEDSFSKPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICFVGDEAFRELSKMDPEGSKLLDDAMAADKSDEWFAKHNKPKASG

SEQ ID NO: 10660 - protein, 452 aa, Artificial Sequence
  Description of Artificial Sequence: Synthetic coding sequence
MGSSQSVEIPGGGTEGYHVLRVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 10661 - protein, 464 aa, Artificial Sequence
  Description of Artificial Sequence: Synthetic coding sequence
MREGSSTLSEIRKLKPGIMVCTCNPSYSNQETEVQENSPGHRAGLEPFFDFIVSINGSRLNKDNDTLKDLLKANVEKPVKMLIYSSKTLELRETSVTPSNLWGGQGLLGVSIRFCSFDGANENVWHVLEVESNSPAALAGLRPHSDYIIGADTVMNESEDLFSLIETHEAKPLKLYVYNTDTDNCREVIITPNSAWGGEGSLGCGIGYGYLHRIPTRPFEEGKKISLPGQMAGTPITPLKDGFTEVQLSSVNPPSLSPPGTTGIEQSLTGLSISSTPPAVSSVLSTGVPTVPLLPPQVNQSLTSVPPMNPATTLPGLMPLPAGLPNLPNLNLNLPAPHIMPGVGLPELVNPGLPPLPSMPPRNLPGIAPLPLPSEFLPSFPLVPESSSAASSGELLSSLPPTSNAPSDPATTTAKADAASSLTVDVTPPTAKAPTTVEDRVGDSTPVSEKPVSAAVDANASESP

SEQ ID NO: 10662 - protein, 132 aa, Artificial Sequence
  Description of Artificial Sequence: Synthetic coding sequence
MISITEWQKIGVGITGFGIFFILFGTLLYFDSVLLAFGNLLFLTGLSLIIGLRKTFWFFFQRHKLKGTSFLLGGVVIVLLRWPLLGMFLETYGFFSLFKGFFPVAFGFLGNVCNIPFLGALFRRLQGTSSMV

SEQ ID NO: 10663 - protein, 138 aa, Artificial Sequence
  Description of Artificial Sequence: Synthetic coding sequence
MISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSFVDKVGESNNMV

SEQ ID NO: 10664 - protein, 613 aa, Artificial Sequence
  Description of Artificial Sequence: Synthetic coding sequence
MAATAVAAAVAGTESAQGPPGPAASLELWLNKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAANRLIKNLVKEEQEKSEKVSKRVSAVEEVRSHVKVLQEMLSMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 10665 - protein, 173 aa, Artificial Sequence [sequence omitted]

SEQ ID NO: 10666 - protein, 286 aa, Artificial Sequence
  Description of Artificial Sequence: Synthetic coding sequence
MAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 10667 - protein, 1002 aa, Artificial Sequence
  Description of Artificial Sequence: Synthetic coding sequence
MWPQPRLPPRPAMSEETRQSKLAAAKKKLREYQQRNSPGVPTGAKKKKKIKNGSNPETTTSGGCHSPEDTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 10668 - protein, 473 aa, Artificial Sequence
  Description of Artificial Sequence: Synthetic coding sequence
MWPQPRLPPRPAMSEETRQSKLAAAKKKLREYQQRNSPGVPTGAKKKKKIKNGSNPETTTSGGCHSPEDIQDILKVLVSDLNRSNGVALPPLDKWKTPKDNAATLQPSDDTVLPGGVPSPGASLTSMAASQNHDADNVPNLMDETKTFSSTESLRQLSQQLNGLVCESATCVNGEGPASSANLKDLESRYQQLAVALDSSYVTNKQLNITIEKLKQQNQEITDQLEEEKKECHQKQGALREQLQVHIQTIGILVSEKAELQTALAHTQHAARQKEGESEDLASRLQYSRRRVGELERALSAVSTQQKKADRYNKELTKERDALRLELYKNTQSNEDLKQEKSELEEKLRVLVTEKAGMQLNLEELQKKLEMTELLLQQFSSRCEAPDANQQLQQAMEERAQLEAHLGQVMESVRQLQMERDKYAENLKGESAMWRQRMQQMSEQVHTLREEKECSMSRVQELETSLAELRNQM

SEQ ID NO: 10669 - protein, 137 aa, Artificial Sequence
  Description of Artificial Sequence: Synthetic coding sequence
MRPQQAPVSGKVFIQRDYSSGTRCQFQTKFPAELENRIDRQQFEETVRTLNNLYAEAEKLGGQSYLEGCLACLTAYTIFLCMETHYEKVLKKVSKYIQEQNEKIYAPQGLLLTDPIERGLRVIEITIYEDRGMSSGR

SEQ ID NO: 10670 - protein, 134 aa, Artificial Sequence
  Description of Artificial Sequence: Synthetic coding sequence
MRPQQAPVSGKVFIQRDYSSGTRCQFQTKFPAELENRIDRQQFEETVRTLNNLYAEAEKLGGQSYLEGCLACLTAYTIFLCMETHYEKVLKKVSKYIQEQNEKIYAPQGLLLTDPIERGLRVFRLKLPFMKTEA

SEQ ID NO: 10671 - protein, 137 aa, Artificial Sequence; identical to SEQ ID NO: 10669
  Description of Artificial Sequence: Synthetic coding sequence

SEQ ID NO: 10672 - protein, 137 aa, Artificial Sequence; identical to SEQ ID NO: 10669
  Description of Artificial Sequence: Synthetic coding sequence

SEQ ID NO: 10673 - protein, 166 aa, Artificial Sequence
  Description of Artificial Sequence: Synthetic coding sequence
MDDQRCPLDDGQAGAAEATAAPTLEDRIAQPSMTASPQTEEFFDLIASSQSRRLDDQRASVGSLPGLRITHSNAGHLRGHGEPQEPGDDFFNMLIKYQSSRIDDQRCPPPDVLPRGPTMPDEDFFSLIQRVQAKRMDEQRVDLAGGPEQGAGGPPEPQQQCQPGAS

SEQ ID NO: 10674 - protein, 652 aa, Artificial Sequence
  Description of Artificial Sequence: Synthetic coding sequence
MEASCLELALEGERLCKAGDFKTGVAFFEAAVQVGTEDLKTLSAIYSQLGNAYFYLKEHGRALEYHKHDLLLARTIGDRMGEAKASGNLGNTLKVLGRFDEAAVCCQRHLSIAQEQGDKVGEARALYNIGNVYHAKGKQLSWNAANATQDPGHLPPDVRETLCKASEFYERNLSLVKELGDRAAQGRAYGNLGNTHYLLGNFTEATTFHKERLAIAKEFGDKAAERRAYSNLGNAHVFLGRFDVAAEYYKKTLQLSRQLRDQAVEAQACYSLGNTYTLLQDYERAAEYHLRHLLIAQELADRVGEGRACWSLGNAYVSMGRPAQALTFAKKHLQISQEIGDRHGELTARMNVAQLQLVLGRLTSPAASEKPDLAGYEAQGARPKRTQRLSAETWDLLRLPLEREQNGDSHHSGDWRGPSRDSLPLPVRSRKYQEGPDAERRPREGSHSPLDSADVRVHVPRTSIPRAPSSDEECFFDLLTKFQSSRMDDQRCPLDDGQAGAAEATAAPTLEDRIAQPSMTASPQTEEFFDLIASSQSRRLDDQRASVGSLPGLRITHSNAGHLRGHGEPQEPGDDFFNMLIKYQSSRIDDQRCPPPDVLPRGPTMPDEDFFSLIQRVQAKRMDEQRVDLAGGPEQGAGGPPEPQQQCQPGAS

SEQ ID NO: 10675 - protein, 166 aa, Artificial Sequence; identical to SEQ ID NO: 10673
  Description of Artificial Sequence: Synthetic coding sequence

SEQ ID NO: 10676 - protein, 457 aa, Artificial Sequence
  Description of Artificial Sequence: Synthetic coding sequence
MAGPAPPVADELPGPAARRLYSRMEASCLELALEGERLCKAGDFKTGVAFFEAAVQVGTEDLKTLSAIYSQLGNAYFYLKEHGRALEYHKHDLLLARTIGDRMGEAKASGNLGNTLKVLGRFDEAAVCCQRHLSIAQEQGDKVGEARALYNIGNVYHAKGKQLSWNAANATQDPGHLPPDVRETLCKASEFYERNLSLVKELGDRAAQGRAYGNLGNTHYLLGNFTEATTFHKERLAIAKEFGDKAAERRAYSNLGNAHVFLGRFDVAAEYYKKTLQLSRQLRDQAVEAQACYSLGNTYTLLQDYERAAEYHLRHLLIAQELADRVGEGRACWSLGNAYVSMGRPAQALTFAKKHLQISQEIGDRHGELTARMNVAQLQLVLGRLTSPAASEKPDLAGYEAQGEFQGCGGVLLPTGTDRIRSCGGVGSRPGQHGGGGSRQKMAPTSQFFLASGTAQA

SEQ ID NO: 10677 - protein, 166 aa, Artificial Sequence; identical to SEQ ID NO: 10673
  Description of Artificial Sequence: Synthetic coding sequence

SEQ ID NO: 10678 - protein, 675 aa, Artificial Sequence
  Description of Artificial Sequence: Synthetic coding sequence
MAGPAPPVADELPGPAARRLYSRMEASCLELALEGERLCKAGDFKTGVAFFEAAVQVGTEDLKTLSAIYSQLGNAYFYLKEHGRALEYHKHDLLLARTIGDRMGEAKASGNLGNTLKVLGRFDEAAVCCQRHLSIAQEQGDKVGEARALYNIGNVYHAKGKQLSWNAANATQDPGHLPPDVRETLCKASEFYERNLSLVKELGDRAAQGRAYGNLGNTHYLLGNFTEATTFHKERLAIAKEFGDKAAERRAYSNLGNAHVFLGRFDVAAEYYKKTLQLSRQLRDQAVEAQACYSLGNTYTLLQDYERAAEYHLRHLLIAQELADRVGEGRACWSLGNAYVSMGRPAQALTFAKKHLQISQEIGDRHGELTARMNVAQLQLVLGRLTSPAASEKPDLAGYEAQGARPKRTQRLSAETWDLLRLPLEREQNGDSHHSGDWRGPSRDSLPLPVRSRKYQEGPDAERRPREGSHSPLDSADVRVHVPRTSIPRAPSSDEECFFDLLTKFQSSRMDDQRCPLDDGQAGAAEATAAPTLEDRIAQPSMTASPQTEEFFDLIASSQSRRLDDQRASVGSLPGLRITHSNAGHLRGHGEPQEPGDDFFNMLIKYQSSRIDDQRCPPPDVLPRGPTMPDEDFFSLIQRVQAKRMDEQRVDLAGGPEQGAGGPPEPQQQCQPGAS

SEQ ID NO: 10679 - protein, 724 aa, Artificial Sequence
  Description of Artificial Sequence: Synthetic coding sequence
MFDTTPHSGRSTPSSSPSLRKRLQLLPPSRPPPEPEPGTMVEKGSDSSSEKGGVPGTPSTQSLGSRNFIRNSKKMQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRLWQNALLEKTLSPRELWHLVHQCYGSELGLTSEDEDYVSPLQLNGLGTPKEVGDVIALSDITSSGAADRSQEPSPVGSRRGHVTPNLSRASSDADHGAEEDKEEQVDSQPDASSSQTVTPVAEPPSTEPTQPDGPTTLGPLDLLPSEELLTDTSNSSSSTGEEADLAALLPDLSGRLLINSVFHVGAERLQQMLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVICVSLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 10680 - protein, 713 aa, Artificial Sequence
  Description of Artificial Sequence: Synthetic coding sequence
MFDTTPHSGRSTPSSSPSLRKRLQLLPPSRPPPEPEPGTMVEKGSDSSSEKGGVPGTPSTQSLGSRNFIRNSKMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRLWQNALLEKTLSPRELWHLVHQCYGSELGLTSEDEDYVSPLQLNGLGTPKEVGDVIALSDITSSGAADRSQEPSPVGSRRGHVTPNLSRASSDADHGAEEDKEEQVDSQPDASSSQTVTPVAEPPSTEPTQPDGPTTLGPLDLLPSEELLTDTSNSSSSTGEEADLAALLPDLSGRLLINSVFHVGAERLQQMLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 10681 - protein, 806 aa, Artificial Sequence
  Description of Artificial Sequence: Synthetic coding sequence
MDDVLPLMPWETLLAQGSPQGSPDLPAGQRKQQPQGDRAQGLASESWKLLEVPIIHITPSSDGESPACTPTPRRRQQQRMPDPQSLSQDSTTPHSGRSTPSSSPSLRKRLQLLPPSRPPPEPEPGTMVEKGSDSSSEKGGVPGTPSTQSLGSRNFIRNSKKMQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRLWQNALLEKTLSPRELWHLVHQCYGSELGLTSEDEDYVSPLQLNGLGTPKEVGDVIALSDITSSGAADRSQEPSPVGSRRGHVTPNLSRASSDADHGAEEDKEEQVDSQPDASSSQTVTPVAEPPSTEPTQPDGPTTLGPLDLLPSEELLTDTSNSSSSTGEEDLAALLPDLSGRLLINSVFHVGAERLQQMLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 10682 - protein, 486 aa, Artificial Sequence
  Description of Artificial Sequence: Synthetic coding sequence
MHCLKRTPKEVGDVIALSDITSSGAADRSQEPSPVGSRRGHVTPNLSRASSDADHGAEEDKEEQVDSQPDASSSQTVTPVAEPPSTEPTQPDGPTTLGPLDLLPSEELLTDTSNSSSSTGEEADLAALLPDLSGRLLINSVFHVGAERLQQMLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 10683 - protein, 738 aa, Artificial Sequence [sequence omitted]

SEQ ID NO: 10684 - protein, 738 aa, Artificial Sequence
  Description of Artificial Sequence: Synthetic coding sequence
MKGFKLSCTASNSNRSTPACSPILRKRSRSPTPQNQDGDTMVEKGSDHSSDKSPSTPEQGVQRSCSSQSGRSGGKNSKKSQSWYNVLSPTYKQRNEDFRKLFKQLPDTERLIVDYSCALQRDILLQGRLYLSENWICFYSNIFRWETLLTVRLKDICSMTKEKTARLIPNAIQVCTDSEKHFFTSFGARDRTYMMMFRLWQNALLEKPLCPKELWHFVHQCYGNELGLTSDDEDYVPPDDDFNTMGYCEEIPVEENEVNDSSSKSSIETKPDASPQLPKKSITNSTLTSTGSSEAPVSFDGLPLEEEALEGDGSLEKELAIDNIMGEKIEMIAPVNSPSLDFNDNEDIPTELSDSSDTHDEGEVQAFYEDLSGRQYVNEVFNFSVDKLYDLLFTNSPFQRDFMEQRRFSDIIFHPWKKEENGNQSRVILYTITLTNPLAPKTATVRETQTMYKASQESECYVIDAEVLTHDVPYHDYFYTINRYTLTRVARNKSRLRVSTELRYRKQPWGLVKTFIEKNFWSGLEDYFRHLESELAKTESTYLAEMHRQSPKEKASKTTTVRRRKRPHAHLRVPHLEEVMSPVTTPTDEDVGHRIKHVAGSTQTRHIPEDTPNGFHLQSVSKLLLVISCVICFSLVLLVILNMMLFYKLWMLEYTTQTLTAWQGLRLQERLPQSQTEWAQLLESQQKYHDTELQKWREIIKSSVMLLDQMKDSLINLQNGIRSRDYTSESEEKRNRYH

SEQ ID NO: 10685 - protein, 745 aa, Artificial Sequence
  Description of Artificial Sequence: Synthetic coding sequence
MKGFKLSCTASNSNRSTPACSPILRKRSRSPTPQNQDGDTMVEKGSDHSSDKSPSTPEQGVQRSCSSQSGRSGGKNSKSHKRLSKKSQSWYNVLSPTYKQRNEDFRKLFKQLPDTERLIVDYSCALQRDILLQGRLYLSENWICFYSNIFRWETLLTVRLKDICSMTKEKTARLIPNAIQVCTDSEKHFFTSFGARDRTYMMMFRLWQNALLEKPLCPKELWHFVHQCYGNELGLTSDDEDYVPPDDDFNTMGYCEEIPVEENEVNDSSSKSSIETKPDASPQLPKKSITNSTLTSTGSSEAPVSFDGLPLEEEALEGDGSLEKELAIDNIMGEKIEMIAPVNSPSLDFNDNEDIPTELSDSSDTHDEGEVQAFYEDLSGRQYVNEVFNFSVDKLYDLLFTNSPFQRDFMEQRRFSDIIFHPWKKEENGNQSRVILYTITLTNPLAPKTATVRETQTMYKASQESECYVIDAEVLTHDVPYHDYFYTINRYTLTRVARNKSRLRVSTELRYRKQPWGLVKTFIEKNFWSGLEDYFRHLESELAKTESTYLAEMHRQSPKEKASKTTTVRRRKRPHAHLRVPHLEEVMSPVTTPTDEDVGHRIKHVAGSTQTRHIPEDTPNGFHLQSVSKLLLVISCVVSFSLVLLVILNMMLFYKLWMLEYTTQTLTAWQGLRLQERLPQSQTEWAQLLESQQKYHDTELQKWREIIKSSVMLLDQMKDSLINLQNGIRSRDYTSESEEKRNRYH

SEQ ID NO: 10686 - protein, 662 aa, Artificial Sequence
  Description of Artificial Sequence: Synthetic coding sequence
MEGAPTVRQVMNEGDSSLATDLQEDVEENPSPTVEENNVVVKKQGPNLHNWSGDWSFWISSSTYKDRNEEYRRQFTHLPDTERLIADYACALQRDILLQGRLYLSENWLCFYSNIFRWETTISIALKNITFMTKEKTARLIPNAIQIVTESEKFFFTSFGARDRSYLSIFRLWQNVLLDKSLTRQEFWQLLQQNYGTELGLNAEEMENLSLSIEDVQPRSPGRSSLDDSGERDEKLSKSISFTSESISRVSETESFDGNSSKGGLGKEESQNEKQTKKSLLPTLEKKLTRVPSKSLDLNKNEYLSLDKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMLQKTFDLLNKNKTGMAVES

SEQ ID NO: 10687 - protein, 457 aa, Artificial Sequence
  Description of Artificial Sequence: Synthetic coding sequence
MENLSLSIEDVQPRSPGRSSLDDSGERDEKLSKSISFTSESISRVSETESFDGNSSKGGLGKEESQNEKQTKKSLLPTLEKKLTRVPSKSLDLNKNEYLSLDKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMLQKTFDLLNKNKTGMAVES

SEQ ID NO: 10688 - protein, 391 aa, Artificial Sequence
  Description of Artificial Sequence: Synthetic coding sequence
MNIFLWTKAALQILLMKYAAGHGLVIRCLPEFRTLGRSTLAPSGQIENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMLQKTFDLLNKNKTGMAVES

SEQ ID NO: 10689 - protein, 380 aa, Artificial Sequence
  Description of Artificial Sequence: Synthetic coding sequence
MENLSLSIEDVQPRSPGRSSLDDSGERDEKLSKSISFTSESISRVSETESFDGNSSKGGLGKEESQNEKQTKKSLLPTLEKKLTRVPSKSLDLNKNEYLSLDKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHA

SEQ ID NO: 10690 - protein, 354 aa, Artificial Sequence
  Description of Artificial Sequence: Synthetic coding sequence
MTALSRSEATEEGGNQQMHRKTASLNSPVSCKEKPDRVEEPPDYSLHWPEGLKGEEIKKCGREGITLNKYNQQYHKLFKDVPLEEVVLKVCSCALQRDFLLQGRLYISPNWLCFHASLFGKDIKVVIPVVSVQMIKKHKMARLLPNGLAITTNTSQKYIFVSLLSRDSVYDLLRRVCTHLQPSSKKSLSVREFSGEPESLEVLIPEMKWRKVCPSSRSLSLPDNIPCIPPSSVDSTDSFFPSRKPPMSEKSRAQVASENGGRWAWPMPGWGPACPKKMPNCSPTAKNAVYEEDELEEEPRSTGELRLWDYRLLKVFFVLICFLVMSSSYLAFRISRLEQQLCSLSWDDPVPGHR

SEQ ID NO: 10691 - protein, 157 aa, Artificial Sequence
  Description of Artificial Sequence: Synthetic coding sequence
MSKSCGNNLAAISVGISLLLLLVVCGIGCVWHWKHRVATRFTLPRFLQRRSSRRKVCTKTFLGPRIIGLRHEISVETQDHKSAVRGNNTHDNYENVEAGPPKAKGKTDKELYENTGQSNFEEHIYGNETSSDYYNFQKPRPSEVPQDEDIYILPDSY

SEQ ID NO: 10692 - protein, 157 aa, Artificial Sequence; identical to SEQ ID NO: 10691
  Description of Artificial Sequence: Synthetic coding sequence

SEQ ID NO: 10693 - protein, 68 aa, Artificial Sequence
  Description of Artificial Sequence: Synthetic coding sequence
MSKSCGNNLAAISVGISLLLLLVVCGIGCVWHWKHRVATRFTLPRFLQRRSSRRKVCTKTFLGPRIIG

SEQ ID NO: 10694 - protein, 69 aa, Artificial Sequence
  Description of Artificial Sequence: Synthetic coding sequence
MSKSCGNNLAAISVGISLLLLLVVCGIGCVWHWKHRVATRFTLPRFLQRRSSRRKVCTKTFLGPRIIGL

SEQ ID NO: 10695 - protein, 250 aa, Artificial Sequence
  Description of Artificial Sequence: Synthetic coding sequence
MIQSSQPMSLKLTCSAFRLQRALRFLLGRLPWRVASGARRFRRWLNRYSYTVLSSWPERALISLKNRSRFLVRPNTRNRAFSWTCRAARSKPRPRRSTALPRSQASSSRHSWAEFLKFRKSFQMSNTSQPDPSRPGTERTSSKEAGCRPLGQLDSFSWAARPPPGAAGLAVSEGFFRKIRSSAPSSPSFSRALMSNTYLCFLTTGPRSSRENTQKSFPATSPREPVTSRLRGKAPALSPSRELSFTSAPF

SEQ ID NO: 10696 - protein, 325 aa, Artificial Sequence
  Description of Artificial Sequence: Synthetic coding sequence
MLAARLVCLRTLPSRVFHPAFTKASPVVKNSITKNQWLLTPSREYATKTRIGIRRGRTGQELKEAALEPSMEKIFKIDQMGRWFVAGGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 10697 - protein, 345 aa, Artificial Sequence
  Description of Artificial Sequence: Synthetic coding sequence
MLAARLVCLRTLPSRVFHPAFTKASPVVKNSITKNQWLLTPSREYATKTRIGIRRGRTGQELKEAALEPSMEKIFKIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 10698 - protein, 319 aa, Artificial Sequence
  Description of Artificial Sequence: Synthetic coding sequence
MLAARLVCLRTLPSRVFHPAFTKASPVVKNSITKNQWLLTPSREYATKTRIGIRRGRTGQELKEAALEPSMEKIFKIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVSSVQKYHQCMEFKNMIPLTRC

SEQ ID NO: 10699 - protein, 332 aa, Artificial Sequence
  Description of Artificial Sequence: Synthetic coding sequence
MLAARLVCLRTLPFVKNSITKNQWLLTPSREYATKTRIGIRRGRTGQELKEAALEPSMEKIFKIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 10700 - protein, 1814 aa, Artificial Sequence
  Description of Artificial Sequence: Synthetic coding sequence
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSGVLVDLGLEENGTAHQRAEKYVVRLDNEIQTKFEVFMRRVKQNPYTLFVLVHDNSHVELTSVISGSLSHSEPSHGLADRVINCREVLEAFNLLVLQVSSFPYTLQTQQSRISSSNEVHWIQLDTGEDVGCEEKLYFGLSEYSKSLQWGITSPLLRCDETFEKMVNTLLERYPRLHSMVVRCYLLIQQYSEALMALTTMASLRDHSTPETLSIMDDLISSPGKNKSGRGHMLIIRVPSVQLAMLAKERLQEVRDKLGLQYRFEIILGNPATELSVATHFVARLKSWRGNEPEEWIPRTYQDLDGLPCIVILTGKDPLGETFPRSLKYCDLRLIDSSYLTRTALEQEVGLACCYVSKEVIRGPTVALDLSGKEQERAAVSENDSDELLIDLERPQSNSSAVTGTSGSIMENGVSSSSTADKSQKQSLTPSFQSPATSLGLDEGVSASSAGAGAGETLKQECDSLGPQMASSTTSKPSSSSSGPRTLPWPGQPIRGCRGPQAALPPVVILSKAAYSLLGSQKSGKLPSSSSLLPHADVAWVSSLRPLLNKDMSSEEQSLYYRQWTLARQHHADYSNQLDPASGTRNFHPRRLLLTGPPQVGKTGSYLQFLRILFRMLIRLLEVDVYDEEEINTDHNESSEVSQSEGEPWPDIESFSKMPFDVSVHDPKYSLMSLVYTEKLAGVKQEVIKESKVEEPRKRETVSIMLTKYAAYNTFHHCEQCRQYMDFTSASQMSDSTLHAFTFSSSMLGEEVQLYFIIPKSKESHFVFSKQGKHLESMRLPLVSDKNLNAVKSPIFTPSSGRHEHGLLNLFHAMEGISHLHLLVVKEYEMPLYRKYWPNHIMLVLPGMFNNAGVGAARFLIKELSYHNLELERNRLEELGIKRQCVWPFIVMMDDSCVLWNIHSVQEPSSQPMEVGVSSKNVSLKTVLQHIEATPKIVHYAILGIQKWSSKLTSQSLKAPFSRCHVHDFILLNTDLTQNVQYDFNRYFCEDADFNLRTNSSGLLICRFNNFSLMKKHVQVGGQRDFIIKPKIMVSESLAPILPLQYICAPDSEHTLLAAPAQFLLEKFLQHASYKLFPKAIHNFRSPVLAIDCYLNIGPEVAICYISSRPHSSNVNCEGVFFSGLLLYLCDSFVGADLKKFKFLKGATLCVICQDRSSLRQTIVRLELEDEWQFRLRDEFQTANSSDDKPLYFLTGRHV

SEQ ID NO: 10701 - protein, 742 aa, Artificial Sequence
  Description of Artificial Sequence: Synthetic coding sequence
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGPDQVPLREEFEQIMLKAMQEFTLRERALQIGAQCVPVSPGQLPWLARLIASVSQDLVHVVVTQNSLAEGISETLRTLSEMRHYQRLPDYVVVICASKIRGNEFCVVVLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSVSFQALCHIANPVMG

SEQ ID NO: 10702 - protein, 1923 aa, Artificial Sequence
  Description of Artificial Sequence: Synthetic coding sequence
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGPDQVPLREEFEQIMLKAMQEFTLRERALQIGAQCVPVSPGQLPWLARLIASVSQDLVHVVVTQNSLAEGISETLRTLSEMRHYQRLPDYVVVICASKIRGNEFCVVVLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSGVLVDLGLEENGTAHQRAEKYVVRLDNEIQTKFEVFMRRVKQNPYTLFVLVHDNSHVELTSVISGSLSHSEPSHGLADRVINCREVLEAFNLLVLQVSSFPYTLQTQQSRISSSNEVHWIQLDTGEDVGCEEKLYFGLSEYSKSLQWGITSPLLRCDETFEKMVNTLLERYPRLHSMVVRCYLLIQQYSEALMALTTMASLRDHSTPETLSIMDDLISSPGKNKSGRGHMLIIRVPSVQLAMLAKERLQEVRDKLGLQYRFEIILGNPATELSVATHFVARLKSWRGNEPEEWIPRTYQDLDGLPCIVILTGKDPLGETFPRSLKYCDLRLIDSSYLTRTALEQEVGLACCYVSKEVIRGPTVALDLSGKEQERAAVSENDSDELLIDLERPQSNSSAVTGTSGSIMENGVSSSSTADKSQKQSLTPSFQSPATSLGLDEGVSASSAGAGAGETLKQECDSLGPQMASSTTSKPSSSSSGPRTLPWPGQPIRGCRGPQAALPPVVILSKAAYSLLGSQKSGKLPSSSSLLPHADVAWVSSLRPLLNKDMSSEEQSLYYRQWTLARQHHADYSNQLDPASGTRNFHPRRLLLTGPPQVGKTGSYLQFLRILFRMLIRLLEVDVYDEEEINTDHNESSEVSQSEGEPWPDIESFSKMPFDVSVHDPKYSLMSLVYTEKLAGVKQEVIKESKVEEPRKRETVSIMLTKYAAYNTFHHCEQCRQYMDFTSASQMSDSTLHAFTFSSSMLGEEVQLYFIIPKSKESHFVFSKQGKHLESMRLPLVSDKNLNAVKSPIFTPSSGRHEHGLLNLFHAMEGISHLHLLVVKEYEMPLYRKYWPNHIMLVLPGMFNNAGVGAARFLIKELSYHNLELERNRLEELGIKRQCVWPFIVMMDDSCVLWNIHSVQEPSSQPMEVGVSSKNVSLKTVLQHIEATPKIVHYAILGIQKWSSKLTSQSLKAPFSRCHVHDFILLNTDLTQNVQYDFNRYFCEDADFNLRTNSSGLLICRFNNFSLMKKHVQVGGQRDFIIKPKIMVSESLAPILPLQYICAPDSEHTLLAAPAQFLLEKFLQHASYKLFPKAIHNFRSPVLAIDCYLNIGPEVAICYISSRPHSSNVNCEGVFFSGLLLYLCDSFVGADLKKFKFLKGATLCVICQDRSSLRQTIVRLELEDEWQFRLRDEFQTANSSDDKPLYFLTGRHV

SEQ ID NO: 10703 - protein, 747 aa, Artificial Sequence
  Description of Artificial Sequence: Synthetic coding sequence
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGPDQVPLREEFEQIMLKAMQEFTLRERALQIGAQCVPVSPGQLPWLARLIASVSQDLVHVVVTQNSLAEGISETLRTLSEMRHYQRLPDYVVVICASKIRGNEFCVVVLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSGSSPGSHIAFSYVLFISCNL

SEQ ID NO: 10704 - protein, 176 aa, Artificial Sequence
  Description of Artificial Sequence: Synthetic coding sequence
MCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERMEKRDGSEEDFHLDCRHERYPARHQPHMADSWPRSSAQEAPELNRQCWVLGHWV

SEQ ID NO: 10705 - protein, 194 aa, Artificial Sequence
  Description of Artificial Sequence: Synthetic coding sequence
MCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERWQIEAQRGRATCPRSHSWMEKRDGSEEDFHLDCRHERYPARHQPHMADSWPRSSAQEAPELNRQCWVLGHWV

SEQ ID NO: 10706 - protein, 280 aa, Artificial Sequence
  Description of Artificial Sequence: Synthetic coding sequence
MKTSRRGRALLAVALNLLALLFATTAFLTTHWCQGTQRVPKPGCGQGGRANCPNSGANATANGTAAPAAAAAAATASGNGPPGGALYSWETGDDRFLFRNFHTGIWYSCEEELSGLGEKCRSFIDLAPASEKGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERMEKRDGSEEDFHLDCRHERYPARHQPHMADSWPRSSAQEAPELNRQCWVLGHWV

SEQ ID NO: 10707 - protein, 331 aa, Artificial Sequence
  Description of Artificial Sequence: Synthetic coding sequence
MKTSRRGRALLAVALNLLALLFATTAFLTTHWCQGTQRVPKPGCGQGGRANCPNSGANATANGTAAPAAAAAAATASGNGPPGGALYSWETGDDRFLFRNFHTGIWYSCEEELSGLGEKCRSFIDLAPASEKGVLWLSVVSEVLYILLLVVGFSLMCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERMEKRDGSEEDFHLDCRHERYPARHQPHMADSWPRSSAQEAPELNRQCWVLGHWV

SEQ ID NO: 10708 - protein, 492 aa, Artificial Sequence
  Description of Artificial Sequence: Synthetic coding sequence
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGVHVVVTGPPNAGKSSLVNLLSRKPVSIVSPEPGTTRDVLETPVDLAGFPVLLSDTAGLREGVGPVEQEGVRRARERLEQADLILAMLDASDLASPSSCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 10709 - protein, 524 aa, Artificial Sequence
  Description of Artificial Sequence: Synthetic coding sequence
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQGGSTWWWGRKTPHISPQRLPSLSLSACLLSPTADIEVRALQVALGAHLRDARRGQRLRSGVHVVVTGPPNAGKSSLVNLLSRKPVSIVSPEPGTTRDVLETPVDLAGFPVLLSDTAGLREGVGPVEQEGVRRARERLEQADLILAMLDASDLASPSSCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 10710 - protein, 514 aa, Artificial Sequence
  Description of Artificial Sequence: Synthetic coding sequence
MVHSPTCPHPCFLLVPASEPQFPHLQTPDPGDAVWNVRWALCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGVHVVVTGPPNAGKSSLVNLLSRKPVSIVSPEPGTTRDVLETPVDLAGFPVLLSDTAGLREGVGPVEQEGVRRARERLEQADLILAMLDASDLASPSSCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 10711 - protein, 151 aa, Artificial Sequence [sequence omitted]

SEQ ID NO: 10712 - protein, 471 aa, Artificial Sequence
  Description of Artificial Sequence: Synthetic coding sequence
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGVHVVVTGPPNAGKSSLVNLLSRKPVSIVSPEPGTTRDVLETPVDLAGFPVLLSDTAGLREGVGPVEQEGVRRARESCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 10713 - protein, 140 aa, Artificial Sequence
  Description of Artificial Sequence: Synthetic coding sequence
MRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINK

SEQ ID NO: 10714 - protein, 634 aa, Artificial Sequence
  Description of Artificial Sequence: Synthetic coding sequence
MAHYNFKKITVVPSAKDFIDLTLSKTQRKTPTVIHKHYQIHRIRHFYMRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKVQRTVLEKEMRSLGVDMDDKDDAHYAVQARRSRSITRKRKREDSAPPSSVARSGSCSRTPRDVSGLRDVKMVKKAKTMMKNAQKKMNRLGKKGEADRHVFDMKPKHLLSGKRKAGKKDRR

SEQ ID NO: 10715 - protein, 518 aa, Artificial Sequence
  Description of Artificial Sequence: Synthetic coding sequence
MKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKVQRTVLEKEMRSLGVDMDDKDDAHYAVQARRSRSITRKRKREDSAPPSSVARSGSCSRTPRDVSGLRDVKMVKKAKTMMKNAQKKMNRLGKKGEADRHVFDMKPKHLLSGKRKAGKKDRR

SEQ ID NO: 10716 - protein, 587 aa, Artificial Sequence
  Description of Artificial Sequence: Synthetic coding sequence
MRKVKFTQQNYHDRLSQILTDFPKLDDIHPFYADLMNILYDKDHYKLALGQINIAKNLVDNVAKDYVRLMKYGDSLYRCKQLKRAALGRMCTVIKRQKQSLEYLEQVRQHLSRLPTIDPNTRTLLLCGYPNVGKSSFINKVTRADVDVQPYAFTTKSLFVGHMDYKYLRWQVVDTPGILDHPLEDRNTIEMQAITALAHLRAAVLYVMDLSEQCGHGLREQLELFQNIRPLFINKPLIVVANKCDVKRIAELSEDDQKIFTDLQSEGFPVIETSTLTEEGVIKVKTEACDRLLAHRVETKMKGNKVNEVLNRLHLAIPTRRDDKERPPFIPEGVVARRKRMETEESRKKRERDLELEMGDDYILDLQKYWDLMNLSEKHDKIPEIWEGHNIADYIDPAIMKKLEELEKEEELRTAAGEYDSVSESEDEEMLEIRQLAKQIREKKKLKILESKEKNTQGPRMPRTAKKVQRTVLEKEMRSLGVDMDDKDDAHYAVQARRSRSITRKRKREDSAPPSSVARSGSCSRTPRDVSGLRDVKMVKKAKTMMKNAQKKMNRLGKKGEADRHVFDMKPKHLLSGKRKAGKKDRR

SEQ ID NO: 10717 - protein, 665 aa, Artificial Sequence
  Description of Artificial Sequence: Synthetic coding sequence
MSEQSCQMSELRLLLLGKCRSGKSATGNAILGKHVFKSKFSDQTVIKMCQRESWVLRERKVVVIDTPDLFSSIACAEDKQRNIQHCLELSAPSLHALLLVIAIGHFTREDEETAKGIQQVFGAEARRHIIIVFTRKDDLGDDLLQDFIEKNKPLKQLVQDYEGRYCIFNNKTNSKDEQITQVLELLRKVESLVNTNGGPYHVNFKTEGSRFQDCVNEAASQEGDKPQGPRERQLQSTGPEQNPGTSELTVLLVGKRGAGKSAAGNSILGRQAFQTGFSEQSVTQSFLSESRSWRKKKVSIIDAPDISSLKNIDSEVRKHICTGPHAFLLVTPLGFYTKNDEAVLSTIQNNFGEKFFEYMIILLTRKEDLGDQDLDTFLRNSNKALYGLIQKCKNRYSAFNYRATGEEEQRQADELLEKIESMVHQNGNKHCVFREKETLNIVLVGRSGTGKSATGNSILGSLVFTSRLRAQPVTKTSQSGRRTWDGQEVVVVDTPSFNQMLDVEKDPSRLEEEVKRCLSCCEKGDTFFVLVFQLGRFTEEDKTAVAKLEAIFGADFTKYAIMLFTRKEDLGAGNLEDFMKNSDNKALRRIFKKCGRRVCAFNNKETGQAQETQVKALLTKVNDLRKESGWSGYPHTQENVSKLIKNVQEMSQAEKLLKNLIGILQ

SEQ ID NO: 10718 - protein, 307 aa, Artificial Sequence
  Description of Artificial Sequence: Synthetic coding sequence
MAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEVRGDSTVHLRAGVTALPLPGRPARGVFYRQSNVGKSSLIKLYFHWPLRLKSESPKNQDTQENEFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 10719 - protein, 251 aa, Artificial Sequence
  Description of Artificial Sequence: Synthetic coding sequence
MAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 10720 - protein, 284 aa, Artificial Sequence
  Description of Artificial Sequence: Synthetic coding sequence
MAAPGLRLGAGRLFEMPAVLERLSRYNSTSQAFAEVLRLPKQQLRKLLYPLQEVERFLAPYGRQDLHLRIFDPSPEDIARADNIFTATERNRIDYVSSAVRIDHAPDLPRPEVCFIGRSNVGKSSLIKALFSLAPEVEVRVSKKPGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 10721 - protein, 173 aa, Artificial Sequence
  Description of Artificial Sequence: Synthetic coding sequence
MVCFIGRSNVGKSSLIKALFSLAPEVEVRVSKKPGHTKKMNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 10722 - protein, 134 aa, Artificial Sequence
  Description of Artificial Sequence: Synthetic coding sequence
MNFFKVGKHFTVVDMPGYGFRAPEDFVDMVETYLKERRNLKRTFLLVDSVVGIQKTDNIAIEMCEEFALPYVIVLTKIDKSSKGHLLKQVLQIQKFVNMKTQGCFPQLFPVSAVTFSGIHLLRCFIASVTGSLD

SEQ ID NO: 10723 - protein, 251 aa, Artificial Sequence; identical to SEQ ID NO: 10719
  Description of Artificial Sequence: Synthetic coding sequence

SEQ ID NO: 10724 - protein, 153 aa, Artificial Sequence
  Description of Artificial Sequence: Synthetic coding sequence
MTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQSHSVAQAGVQ

SEQ ID NO: 10725 - protein, 317 aa, Artificial Sequence [sequence omitted]

SEQ ID NO: 10726 - protein, 68 aa, Artificial Sequence
  Description of Artificial Sequence: Synthetic coding sequence
MSSGASASALQRLVEQLKLEAGVERIKVSQAAAELQQYCMQNACKDALLVGVPAGSNPFREPRSCALL

SEQ ID NO: 10727 - protein, 72 aa, Artificial Sequence
  Description of Artificial Sequence: Synthetic coding sequence
MSSKTASTNNIAQARRTVQQLRLEASIERIKVSKASADLMSYCEEHARSDPLLIGIPTSENPFKDKKTCIIL

SEQ ID NO: 10728 - protein, 75 aa, Artificial Sequence
  Description of Artificial Sequence: Synthetic coding sequence
MKGETPVNSTMSIGQARKMVEQLKIEASLCRIKVSKAAADLMTYCDAHACEDPLITPVPTSENPFREKKFFCALL

SEQ ID NO: 10729 - protein, 75 aa, Artificial Sequence
  Description of Artificial Sequence: Synthetic coding sequence
MKEGMSNNSTTSISQARKAVEQLKMEACMDRVKVSQAAADLLAYCEAHVREDPLIIPVPASENPFREKKFFCTIL

SEQ ID NO: 10730 - protein, 75 aa, Artificial Sequence; identical to SEQ ID NO: 10729
  Description of Artificial Sequence: Synthetic coding sequence

SEQ ID NO: 10731 - protein, 75 aa, Artificial Sequence; identical to SEQ ID NO: 10729
  Description of Artificial Sequence: Synthetic coding sequence

SEQ ID NO: 10732 - protein, 75 aa, Artificial Sequence; identical to SEQ ID NO: 10729
  Description of Artificial Sequence: Synthetic coding sequence

SEQ ID NO: 10733 - protein, 68 aa, Artificial Sequence
  Description of Artificial Sequence: Synthetic coding sequence
MSATNNIAQARKLVEQLRIEAGIERIKVSKAASDLMSYCEQHARNDPLLVGVPASENPFKDKKPCIIL

SEQ ID NO: 10734 - protein, 46 aa, Artificial Sequence
  Description of Artificial Sequence: Synthetic coding sequence
MPVINIEDLTEKDKLKMEVDQLKKEVTLERMLIPARHLQNQSLMDY

SEQ ID NO: 10735 - protein, 46 aa, Artificial Sequence; identical to SEQ ID NO: 10734
  Description of Artificial Sequence: Synthetic coding sequence

SEQ ID NO: 10736 - protein, 46 aa, Artificial Sequence; identical to SEQ ID NO: 10734
  Description of Artificial Sequence: Synthetic coding sequence

SEQ ID NO: 10737 - protein, 354 aa, Artificial Sequence
  Description of Artificial Sequence: Synthetic coding sequence
MGSGISSESKESAKRSKELEKKLQEDAERDARTVKLLLLGAGESGKSTIVKQMKIIHKNGYSEQECMEFKAVIYSNTLQSILAIVKAMTTLGIDYVNPRSAEDQRQLYAMANTLEDGGMTPQLAEVIKRLWRDPGIQACFERASEYQLNDSAAYYLNDLDRITASGYVPNEQDVLHSRVKTTGIIETQFSFKDLHFRMFDVGGQRSERKKWIHCFEGVTCIIFCAALSAYDMVLVEDEEVNRMHESLHLFNSICNHKYFSTTSIVLFLNKKDIFQEKVTKVHLSICFPEYTGPNTFEDAGNYIKNQFLDLNLKKEDKEIYSHMTCATDTQNVKFVFDAVTDIIIKENLKDCGLF

SEQ ID NO: 10738 - protein, 582 aa, Artificial Sequence
  Description of Artificial Sequence: Synthetic coding sequence
MMKLRHKNKKPGEGSKGHKKISWPYPQPAKQNGKKATSKVPSAPHFVHPNDHANREAELKKKWVEEMREKQQAAREQERQKRRTIESYCQDVLRRQEEFEHKEEVLQELNMFPQLDDEATRKAYYKEFRKVVEYSDVILEVLDARDPLGCRCFQMEEAVLRAQGNKKLVLVLNKIDLVPKEVVEKWLDYLRNELPTVAFKASTQHQVKNLNRCSVPVDQASESLLKSKACFGAENLMRVLGNYCRLGEVRTHIRVGVVGLPNVGKSSLINSLKRSRACSVGAVPGITKFMQEVYLDKFIRLLDAPGIVPGPNSEVGTILRNCVHVQKLADPVTPVETILQRCNLEEISNYYGVSGFQTTEHFLTAVAHRLGKKKKGGLYSQEQAAKAVLADWVSGKISFYIPPPATHTLPTHLSAEIVKEMTEVFDIEDTEQANEDTMECLATGESDELLGDTDPLEMEIKLLHSPMTKIADAIENKTTVYKIGDLTGYCTNPNRHQMGWAKRNVDHRPKSNSMVDVCSVDRRSVLQRIMETDPLQQGQALASALKNKKKMQKRADKIASKLSDSMMSALDLSGNADDGVGD

SEQ ID NO: 10739 - protein, 582 aa, Artificial Sequence; identical to SEQ ID NO: 10738
  Description of Artificial Sequence: Synthetic coding sequence

SEQ ID NO: 10740 - protein, 669 aa, Artificial Sequence
  Description of Artificial Sequence: Synthetic coding sequence
MWTLVGRGWGCARALAPRATGAALLVAPGPRSAPTLGAAPESWATDRLYSSAEFKEKLDMSRFPVENIRNFSIVAHVDHGKSTLADRLLELTGTIDKTKNNKQVLDKLQVERERGITVKAQTASLFYNCEGKQYLLNLIDTPGHVDFSYEVSRSLSACQGVLLVVDANEGIQAQTVANFFLAFEAQLSVIPVINKIDLKNADPERVENQIEKVFDIPSDECIKISAKLGTNVESVLQAIIERIPPPKVHRKNPLRALVFDSTFDQYRGVIANVALFDGVVSKGDKIVSAHTQKTYEVNEVGVLNPNEQPTHKLYAGQVGYLIAGMKDVTEAQIGDTLCLHKQPVEPLPGFKSAKPMVFAGMYPLDQSEYNNLKSAIEKLTLNDSSVTVHRDSSLALGAGWRLGFLGLLHMEVFNQRLEQEYNASVILTTPTVPYKAVLSSSKLIKEHREKEITIINPAQFPDKSKVTEYLEPVVLGTIITPDEYTGKIMMLCEARRAVQKNMIFIDQNRVMLKYLFPLNEIVVDFYDSLKSLSSGYASFDYEDAGYQTAELVKMDILLNGNTVEELVTVVHKDKAHSIGKAICERLKDSLPRQLFEIAIQAAIGSKIIARETVKAYRKNVLAKCYGGDITRKMKLLKRQAEGKKKLRKIGNVEVPKDAFIKVLKTQSSK

SEQ ID NO: 10741 - protein, 251 aa, Artificial Sequence
  Description of Artificial Sequence: Synthetic coding sequence
MAHRLQIRLLTWDVKDTLLRLRHPLGEAYATKARAHGLEVEPSALEQGFRQAYRAQSHSFPNYGLSHGLTSRQWWLDVVLQTFHLAGVQDAQAVAPIAEQLYKDFSHPCTWQVLDGAEDTLRECRTRGLRLAVISNFDRRLEGILGGLGLREHFDFVLTSEAAGWPKPDPRIFQEALRLAHMEPVVAAHVGDNYLCDYQGPRAVGMHSFLVVGPQALDPVVRDSVPKEHILPSLAHLLPALDCLEGSTPGL

SEQ ID NO: 10742 - protein, 251 aa, Artificial Sequence; identical to SEQ ID NO: 10741
  Description of Artificial Sequence: Synthetic coding sequence

SEQ ID NO: 10743 - protein, 288 aa, Artificial Sequence
  Description of Artificial Sequence: Synthetic coding sequence
MDIGLSIANSSGFQLSEFILIGFPGIHEWQHWLSLPLALGANLLIIITIQHETMLHEPMYHLLGILAVVDIGLATTIMPKILAIFWFDAKAISLPECFAQIYAIHSFMCMESGIFLCMAVDRYMAICYPLQYTSIVTEAFVIKATLSVVLRNGLLTIPVPVLAAQRHYCSRNEIDQCLCSNLGVTSLACDDTTINRFYQLALVWVVVGSDMGLVFASYSLIIHSVLKLNSAKATSKALNTCSSHLILILFFYTAIIVVSVTTWQEEGLPASLFSSMCCILSSPQPLTP

SEQ ID NO: 10744 - protein, 170 aa, Artificial Sequence
  Description of Artificial Sequence: Synthetic coding sequence
MASVSSATFSGHGARSLLQFLRLVGQLKRVPRTGWVYRNVQRPESVSDHMYRMAVMAMVIKDDRLNKDREAMKQITQLLPEDLRKELYELWEEYETQSSAEAKFVKQLDQCEMILQASEYEDLEHKPGRLQDFYDSTAGKFNHPEIVQLVSELEAERSTNIAAAASEPHS

SEQ ID NO: 10745 - protein, 204 aa, Artificial Sequence
  Description of Artificial Sequence: Synthetic coding sequence
MASVSSATFSGHGARSLLQFLRLVGQLKRVPRTGWVYRNVQRPESVSDHMYRMAVMAMVIKDDRLNKDRCVRLALVHDMAECIVGDIAPADNIPKEEKHRREEEAMKQITQLLPEDLRKELYELWEEYETQSSAEAKFVKQLDQCEMILQASEYEDLEHKPGRLQDFYDSTAGKFNHPEIVQLVSELEAERSTNIAAAASEPHS

SEQ ID NO: 10746 - protein, 1044 aa, Artificial Sequence
  Description of Artificial Sequence: Synthetic coding sequence
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVEQPCEEGIVILMLRISWERQQQAVTGARSWRVTHSALPHGADGHQTETSSNLLVLQV

SEQ ID NO: 10747 - protein, 392 aa, Artificial Sequence
  Description of Artificial Sequence: Synthetic coding sequence
MVLMDIRRRLPAICWFCKSEAPGRAEPGIQCAIPVHGRPGGCPAPLSLGSNDPLLPQLLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREVVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 10748 - protein, 1030 aa, Artificial Sequence
  Description of Artificial Sequence: Synthetic coding sequence
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVEQPCEEGIVILMLRPQDLMGKATTSSHRGSELESDTLSFATWC

SEQ ID NO: 10749 - protein, 1289 aa, Artificial Sequence
  Description of Artificial Sequence: Synthetic coding sequence
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEDGVSLLLPRLECNGAISAHCNLCLPGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFIAIQMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREVVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIATPRGQRFHLLCPPLYSQPLEQAGSAERAKNLKRSPYL

SEQ ID NO: 10750 - protein, 1323 aa, Artificial Sequence
  Description of Artificial Sequence: Synthetic coding sequence
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREVVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 10751 - protein, 841 aa, Artificial Sequence
  Description of Artificial Sequence: Synthetic coding sequence
MEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREVVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 10752 - protein, 540 aa, Artificial Sequence
  Description of Artificial Sequence: Synthetic coding sequence
MALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLASSSRWSRCAGSPRNTLWGGWQKA

SEQ ID NO: 10753 - protein, 471 aa, Artificial Sequence
  Description of Artificial Sequence: Synthetic coding sequence
MAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 10754 - protein, 263 aa, Artificial Sequence
  Description of Artificial Sequence: Synthetic coding sequence
MAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 10755 - protein, 504 aa, Artificial Sequence
  Description of Artificial Sequence: Synthetic coding sequence
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPFFFFGPIMTFDRFHAQVSQVEPVRREGELWHIRAQAGLSVVAIMAVDIFFHFFYILTIPSDLKFANRLPDSALAGLAYSNLVYDWVKAAVLFGVVNTVACLDHLDPPQPPKCITALYVFAETHFDRGINDWLCKYVYNHIGGEHSAVIPELAATVATFAITTLWLGPCDIVYLWSFLNCFGLNFELWMQKLAEWGPLARIEASLSVQMSRRVRALFGAMNFWAIIMYNLVSLNSLKFTELVARRLLLTGFPQTTLSILFVTYCGVQLVKERERTLALEEEQKQDKEKPE

SEQ ID NO: 10756 - protein, 245 aa, Artificial Sequence
  Description of Artificial Sequence: Synthetic coding sequence
MVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPFFFFGPIMTFDRFHAQVSQVEPVRREGELWHIRAQAGLSVVAIMAVDIFFHFFYILSPATSSSPTASQTVPSAGLAYSNLVYDWVKGRPLWCCQHWHASTTWTHPPPKCITALYVFAETHF

SEQ ID NO: 10757 - protein, 231 aa, Artificial Sequence
  Description of Artificial Sequence: Synthetic coding sequence
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPFFFFGPIMTFDRFHAQ

SEQ ID NO: 10758 - protein, 504 aa, Artificial Sequence; identical to SEQ ID NO: 10755
  Description of Artificial Sequence: Synthetic coding sequence

SEQ ID NO: 10759 - protein, 93 aa, Artificial Sequence
  Description of Artificial Sequence: Synthetic coding sequence
MIHLGHILFLLLLPVAAAQTTPGERSSLPAFYPGTSGSCSGCGSLSLPLLAGLVAADAVASLLIVGAVFLCARPRRSPAQEDGKVYINMPGRG

SEQ ID NO: 10760 - protein, 92 aa, Artificial Sequence
  Description of Artificial Sequence: Synthetic coding sequence
MIHLGHILFLLLLPVAAAQTTPGERSSLPAFYPGTSGSCSGCGSLSLPLLAGLVAADAVASLLIVGAVFLCARPRRSPAQDGKVYINMPGRG

SEQ ID NO: 10761 - protein, 307 aa, Artificial Sequence
  Description of Artificial Sequence: Synthetic coding sequence
MAALLLGAVLLVAQPQLVPSRPAELGQQELLRKAGTLQDDVRDGVAPNGSAQQLPQTIIIGVRKGGTRALLEMLSLHPDVAAAENEVHFFDWEEHYSHGLGWYLSQMPFSWPHQLTVEKTPAYFTSPKVPERVYSMNPSIRLLLILRDPSERVLSDYTQVFYNHMQKHKPYPSIEEFLVRDGRLNVDYKALNRSLYHVHMQNWLRFFPLRHIHIVDGDRLIRDPFPEIQKVERFLKLSPQINASNFYFNKTKGFYCLRDSGRDRCLHESKGRAHPQVDPKLLNKLHEYFHEPNKKFFELVGRTFDWH

SEQ ID NO: 10762 - protein, 83 aa, Artificial Sequence
  Description of Artificial Sequence: Synthetic coding sequence
MAALLLGAVLLVAQPQLVPSRPAELGQQELLRKAGTLQDDVRDGVAPNGSAQQLPQTIIIGVRKGGTRALLEMLSLHPDVAAA

SEQ ID NO: 10763 - protein, 83 aa, Artificial Sequence; identical to SEQ ID NO: 10762
  Description of Artificial Sequence: Synthetic coding sequence

SEQ ID NO: 10764 - protein, 342 aa, Artificial Sequence
  Description of Artificial Sequence: Synthetic coding sequence
MAGSGGLGGGAGGGQGAGAGQGAALRASRAPMLLVALVLGAYCLCALPGRCPPAARAPAPAPAPSEPSSSVHRPGAPGLPLASGPGRRRFPQALIVGVKKGGTRALLEFLRLHPDVRALGSEPHFFDRCYERGLAWYRSLMPRTLDGQITMEKTPSYFVTREAPRRIHAMSPDTKLIVVVRNPVTRAISDYAQTLSKTPGLPSFRALAFRHGLGPVDTAWSAVRIGLYAQHLDHWLRYFPLSHFLFVSGERLVSDPAGEVGRVQDFLGLKRVVTDKHFYFNATKGFPCLKKAQGGSRPRCLGKSKGRPHPRVPQALVRRLQEFYRPFNRRFYQMTGQDFGWG

SEQ ID NO: 10765 - protein, 311 aa, Artificial Sequence
  Description of Artificial Sequence: Synthetic coding sequence
MLLVALVLGAYCLCALPGRCPPAARAPAPAPAPSEPSSSVHRPGAPGLPLASGPGRRRFPQALIVGVKKGGTRALLEFLRLHPDVRALGSEPHFFDRCYERGLAWYRSLMPRTLDGQITMEKTPSYFVTREAPRRIHAMSPDTKLIVVVRNPVTRAISDYAQTLSKTPGLPSFRALAFRHGLGPVDTAWSAVRIGLYAQHLDHWLRYFPLSHFLFVSGERLVSDPAGEVGRVQDFLGLKRVVTDKHFYFNATKGFPCLKKAQGGSRPRCLGKSKGRPHPRVPQALVRRLQEFYRPFNRRFYQMTGQDFGWG

SEQ ID NO: 10766 - protein, 381 aa, Artificial Sequence
  Description of Artificial Sequence: Synthetic coding sequence
AAGPPGAEHKPGTHGLSGARAEMRARLLPPLPGLERRDPMAGSGGLGGGAGGGQGAGAGQGAALRASRAPMLLVALVLGAYCLCALPGRCPPAARAPAPAPAPSEPSSSVHRPGAPGLPLASGPGRRRFPQALIVGVKKGGTRALLEFLRLHPDVRALGSEPHFFDRCYERGLAWYRSLMPRTLDGQITMEKTPSYFVTREAPRRIHAMSPDTKLIVVVRNPVTRAISDYAQTLSKTPGLPSFRALAFRHGLGPVDTAWSAVRIGLYAQHLDHWLRYFPLSHFLFVSGERLVSDPAGEVGRVQDFLGLKRVVTDKHFYFNATKGFPCLKKAQGGSRPRCLGKSKGRPHPRVPQALVRRLQEFYRPFNRRFYQMTGQDFGWG

SEQ ID NO: 10767 - protein, 301 aa, Artificial Sequence
  Description of Artificial Sequence: Synthetic coding sequence
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 10768 - protein, 1159 aa, Artificial Sequence
  Description of Artificial Sequence: Synthetic coding sequence
MPRKQPAGCIFLLTFLGLSGLVGTVTRTYYIGIVEEYWNYVPQGKNVITGKSFTEDKLATLFLERGPNRIGSIYKKAVYRRFTDGTYSIEIPKPPWLGFLGPILRAEVGDVIVIHLKNFASRPYSLHPHGVFYNKDSEGALYPDGTSGRNKNDDMVPPGKNYTYVWPVREEYAPTPADANCLTWVYHSHIDAPKDICSGLIGPLLVCKEGILNRYSGTRNDVDREFVIMFTLVDENQSWYLNENIKHFCTNPDSVDKKDAVFQRSNKMHALNGYLFGNFPEPDMCVGESVSWHLFGMGNEIDIHSIYFYGNTFISRGHRTDVVNLFPATFLTTEMIAENPGKWMITCQVSDHLQAGMLGQYNVDNCKSDIFYPKMKGQQRRYFIAAEKILWDYAPQGYNKFSGLPLNASGSDSDLYFTQGDNRIGGKYWKVRYTEFVDATFTKRKRLSAEEAHLGILGPVIKAEVGDTLLVTFANKADKVYSILPHGVIYDKASDAAPNLDGFVKPGAHVKPGETFTYKWTVPESVSPTAGDPPCLTYLYFSAVDPIKDTSSGLVGPLLVCKKGVLNADGTQKGIDKEFYLLFTVFDENLSRYFDENIQKFIWHPFSIDKEDKEFVKSNRMHAVNGYMYGNQPGLNMCKRDRVSWHLIGLGTDTDMHGIVFQGNTIHLRGTHRDSLALFPHMATTAFMQPDHAGIFRVFCATMPHLSRGMGQIYEVSSCDNRDPSEQRYGMIRTFYIAAEEVEWDYAPNKNWEFEKQHVDARGERHGDIFMNRTENWIGSQYKKVVYREYTDGEFVEIKARPPREEHLELLGPMIHAEVGNTVLIIFKNKASRPYSISAQGVEEMDSGKQFQVPMTKPGEVKTYRWNIPKRSGPGPSDPNCIPWVYYSTVNFVKDTYSGLMGPLITCRKGVLNEKGRRSDVDYEFALLFLVFNENESWYLDDNIKKYLNKDPRDFKRTDDFEESNRMHAINGKIFGNLHGLIMNEDTMTNWYLLGIGSEVDIHTIHYHAESFLFKIDKSYREDVYDLFPGTFQTIELFADHPGTWLLHCHVSDHIHAGMETTYTVLRNIDNRIPYSTTSPGVASHPATVPSNERPGKEQLYFFGKNLGPTGAKAALVILFIIGLLLLITTVILSLRLCSAMKQTDYQQVQSCALPTDAL

SEQ ID NO: 10769 - protein, 406 aa, Artificial Sequence
  Description of Artificial Sequence: Synthetic coding sequence
MDQSGMEIPVTLIIKAPNQKYSDQTISCFLNWTVGKLKTHLSNVYPSKPLTKDQRLVYSGRLLPDHLQLKDILRKQDEYHMVHLVCTSRTPPSSPKSSTNRESHEALASSSNSSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYQAAVSAQATSNVNPTQPTTSQPLNLAHVPGEEPPPAPNLVAQENRPMNENVQMNAQGGPVLNEEDFNRDWLDWMYTFSRAAILLSIVYFYSSFSRFIMVMGAMLLVYLHQAGWFPFRQEGGHQQAPNNNAEVNNDGQNANNLELEEMERLMDDGLEDESGEDGGEDASAIQRPGLMASAWSFITTFFTSLIPEGPPQVAN

SEQ ID NO: 10770 - protein, 406 aa, Artificial Sequence; identical to SEQ ID NO: 10769
  Description of Artificial Sequence: Synthetic coding sequence

SEQ ID NO: 10771 - protein, 414 aa, Artificial Sequence
  Description of Artificial Sequence: Synthetic coding sequence
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVPLSGKV

SEQ ID NO: 10772 - protein, 97 aa, Artificial Sequence
  Description of Artificial Sequence: Synthetic coding sequence
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYN

SEQ ID NO: 10773 - protein, 145 aa, Artificial Sequence
  Description of Artificial Sequence: Synthetic coding sequence
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPV

SEQ ID NO: 10774 - protein, 414 aa, Artificial Sequence; identical to SEQ ID NO: 10771
  Description of Artificial Sequence: Synthetic coding sequence

SEQ ID NO: 10775 - protein, 136 aa, Artificial Sequence
  Description of Artificial Sequence: Synthetic coding sequence
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVL

SEQ ID NO: 10776 - protein, 414 aa, Artificial Sequence; identical to SEQ ID NO: 10771
  Description of Artificial Sequence: Synthetic coding sequence

SEQ ID NO: 10777 - protein, 730 aa, Artificial Sequence
  Description of Artificial Sequence: Synthetic coding sequence
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 10778 - protein, 691 aa, Artificial Sequence
  Description of Artificial Sequence: Synthetic coding sequence
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 10779 - protein, 287 aa, Artificial Sequence
  Description of Artificial Sequence: Synthetic coding sequence
MGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 10780 - protein, 615 aa, Artificial Sequence
  Description of Artificial Sequence: Synthetic coding sequence
NGSHLKTWLKKKGCAVVEFKMEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 10781 - protein, 917 aa, Artificial Sequence
  Description of Artificial Sequence: Synthetic coding sequence
MFAVHLMAFYFSKLKEDQIKKVDRFLYHMRLSDDTLLDIMRRFRAEMEKGLAKDTNPTAAVKMLPTFVRAIPDGSENGEFLSLDLGGSKFRVLKVQVAEEGKRHVQMESQFYPTPNEIIRGNGTELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKMRAELEYGLKKKSHGLATVRMLPTYVCGLPDGTEKGKFLALDLGGTNFRVLLVKIRSGRRSVRMYNKIFAIPLEIMQGTGEELFDHIVQCIADFLDYMGLKGASLPLGFTFSFPCRQMSIDKGTLIGWTKGFKATDCEGEDVVDMLREAIKRRNEFDLDIVAVVNDTVGTMMTCGYEDPNCEIGLIAGTGSNMCYMEDMRNIEMVEGGEGKMCINTEWGGFGDNGCIDDIWTRYDTEVDEGSLNPGKQRYEKMTSGMYLGEIVRQILIDLTKQGLLFRGQISERLRTRGIFETKFLSQIESDRLALLQVRRILQQLGLDSTCEDSIVVKEVCGAVSRRAAQLCGAGLAAIVEKRREDQGLEHLRITVGVDGTLYKLHPHFSRILQETVKELAPRCDVTFMLSEDGSGKGAALITAVAKRLQQAQKEN

SEQ ID NO: 10782 - protein, 806 aa, Artificial Sequence
  Description of Artificial Sequence: Synthetic coding sequence
MFAVHLMAFYFSKLKEDQIKKVDRFLYHMRLSDDTLLDIMRRFRAEMEKGLAKDTNPTAAVKMLPTFVRAIPDGSENGEFLSLDLGGSKFRVLKVQVAEEGKRHVQMESQFYPTPNEIIRGNGTELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKMRAELEYGLKKKSHGLATVRMLPTYVCGLPDGTEKGKFLALDLGGTNFRVLLVKIRSGRRSVRMYNKIFAIPLEIMQGTGEELFDHIVQCIADFLDYMGLKGASLPLGFTFSFPCRQMSIDKGTLIGWTKGFKATDCEGEDVVDMLREAIKRRNEFDLDIVAVVNDTVGTMMTCGYEDPNCEIGLIAGTGSNMCYMEDMRNIEMVEGGEGKMCINTEWGGFGDNGCIDDIWTRYDTEVDEGSLNPGKQRYEKMTSGMYLGEIVRQILIDLTKQGLLFRGQISERLRTRGIFETKFLSQIERMLSVIDAYCLDLLFH

SEQ ID NO: 10783 - protein, 736 aa, Artificial Sequence
  Description of Artificial Sequence: Synthetic coding sequence
MFAVHLMAFYFSKLKEDQIKKVDRFLYHMRLSDDTLLDIMRRFRAEMEKGLAKDTNPTAAVKMLPTFVRAIPDGSENGEFLSLDLGGSKFRVLKVQVAEEGKRHVQMESQFYPTPNEIIRGNGTELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKMRAELEYGLKKKSHGLATVRMLPTYVCGLPDGTEKGKFLALDLGGTNFRVLLVKIRSGRRSVRMYNKIFAIPLEIMQGTGEELFDHIVQCIADFLDYMGLKGASLPLGFTFSFPCRQMSIDKGTLIGWTKGFKATDCEGEDVVDMLREAIKRRNEFDLDIVAVVNDTVGTMMTCGYEDPNCEIGLIAGTGSNMCYMEDMRNIEMVEGGEGKMCICFSFCLWFVLQVLIVVLRIVRYRKSSKLIKKF

SEQ ID NO: 10784 - protein, 93 aa, Artificial Sequence [sequence omitted]

SEQ ID NO: 10785 - protein, 93 aa, Artificial Sequence [sequence omitted]

SEQ ID NO: 10786 - protein, 107 aa, Artificial Sequence
  Description of Artificial Sequence: Synthetic coding sequence
MEQKLVEEILQAITMSTDTGVSLPSYEEDQGSKLIRKAKEAPFVPVGIAGFAAIVAYGLYKLKSRGNTKMSIHLIHMRVAAQGFVVGAMTVGMGYSMYREFWAKPKP

SEQ ID NO: 10787 - protein, 99 aa, Artificial Sequence
  Description of Artificial Sequence: Synthetic coding sequence
MSANRRWWVPPDDEDCVSEKLLRKTRESPLVPIGLGGCLVVAAYRIYRLRSRGSTKMSIHLIHTRVAAQACAVGAIMLGAVYTMYSDYVKRMAQDAGEK

SEQ ID NO: 10788 - protein, 106 aa, Artificial Sequence
  Description of Artificial Sequence: Synthetic coding sequence
MATPGPVIPEVPFEPSKPPVIEGLSPTVYRNPESFKEKFVRKTRENPVVPIGCLATAAALTYGLYSFHRGNSQRSQLMMRTRIAAQGFTVAAILLGLAVTAMKSRP

SEQ ID NO: 10789 - protein, 106 aa, Artificial Sequence
  Description of Artificial Sequence: Synthetic coding sequence
MATLGFVTPEAPFESSKPPIFEGLSPTVYSNPEGFKEKFLRKTRENPVVPIGFLCTAAVLTNGLYCFHQGNSQCSRLMMHTQIAAQGFTIAAILLGLAATAMKSPP

SEQ ID NO: 10790 - protein, 490 aa, Artificial Sequence
  Description of Artificial Sequence: Synthetic coding sequence
MTQGKKKKRAANRSIMLAKKIIIKDGGTPQGIGSPSVYHAVIVIFLEFFAWGLLTAPTLVVLHETFPKHTFLMNGLIQGVKGLLSFLSAPLIGALSDVWGRKSFLLLTVFFTCAPIPLMKISPWWYFAVISVSGVFAVTFSVVFAYVADITQEHERSMAYGLVSATFAASLVTSPAIGAYLGRVYGDSLVVVLATAIALLDICFILVAVPESLPEKMRPASWGAPISWEQADPFASLKKVGQDSIVLLICITVFLSYLPEAGQYSSFFLYLRQIMKFSPESVAAFIAVLGILSIIAQTIVLSLLMRSIGNKNTILLGLGFQILQLAWYGFGSEPWMMWAAGAVAAMSSITFPAVSALVSRTADADQQGVVQGMITGIRGLCNGLGPALYGFIFYIFHVELKELPITGTDLGTNTSPQHHFEQNSIIPGPPFLFGACSVLLALLVALFIPEHTNLSLRSSSWRKHCGSHSHPHNTQAPGEAKEPLLQDTNV

SEQ ID NO: 10791 - protein, 120 aa, Artificial Sequence
  Description of Artificial Sequence: Synthetic coding sequence
  MOD_RES (1)..(1): Any amino acid
XHETFPKHTFLMNGLIQGVKGLLSFLSAPLIGALSDVWGRKSFLLLTVFFTCAPIPLMKISPWWYFAVISVSGVFAVTFSVVFAYVADITQEHERSMAYGLVCMFILYLLYLLRNALFLR

SEQ ID NO: 10792 - protein, 153 aa, Artificial Sequence
  Description of Artificial Sequence: Synthetic coding sequence
MVGILSIVAQTAFLSILMRSLGNKNTVLLGLGFQMLQLAWYGFGSQAWMMWAAGTVAAMSSITFPAISALVSRNAESDQQGVAQDHNWNKRTMQWPGALYGFIFYMFHVELTELGPKLNSNNVPLQGSCHPRPAVFIWGMYSPYVFSGCLIHS

SEQ ID NO: 10793 - protein, 506 aa, Artificial Sequence
  Description of Artificial Sequence: Synthetic coding sequence
MSVEPPPELEEKAASEPEAGAMPEKRAGAQAAGSTWLQGFGRPSVYHAAIVIFLEFFAWGLLTTPMLTVLHETFSQHTFLMNGLIQGVKGLLSFLSAPLIGALSDVWGRKPFLLGTVFFTCFPIPLMRISPWWYFAMISVSGVFSVTFSVIFAYVADVTQEHERSTAYGWVSATFAASLVSSPAIGAYLSASYGDSLVVLVATVVALLDICFILVAVPESLPEKMRPVSWGAQISWKQADPFASLKKVGKDSTVLLICITVFLSYLPEAGQYSSFFLYLRQVIGFGSVKIAAFIAMVGILSIVAQTAFLSILMRSLGNKNTVLLGLGFQMLQLAWYGFGSQAWMMWAAGTVAAMSSITFPAISALVSRNAESDQQGVAQGIITGIRGLCNGLGPALYGFIFYMFHVELTELGPKLNSNNVPLQGAVIPGPPFLFGACIVLMSFLVALFIPEYSKASGVQKHSNSSSGSLTNTPERGSDEDIEPLLQDSSIWELSSFEEPGNQCTEL

SEQ ID NO: 10794 - protein, 311 aa, Artificial Sequence
  Description of Artificial Sequence: Synthetic coding sequence
MLTVLHETFSQHTFLMNGLIQGVKGLLSFLSAPLIGALSDVWGRKPFLLGTVFFTCFPIPLMRISPWWYFAMISVSGVFSVTFSVIFAYVADVTQEHERSTAYGWVSATFAASLVSSPAIGAYLSASYGDSLVVLVATVVALLDICFILVAVPESLPEKMRPVSWGAQISWKQADPFASLKKVGKDSTVLLICITVFLSYLPEAGQYSSFFLYLRQVIGFGSVKIAAFIAMVGILSIVAQTAFLSILMRSLGNKNTVLLGLGFQMLQLAWYGFGSQAWSCPGDHNWNKRTMQWPGASTVWLHILHVPCGTD

SEQ ID NO: 10795 - protein, 134 aa, Artificial Sequence
  Description of Artificial Sequence: Synthetic coding sequence
MSVEPPPELEEKAASEPEAGAMPEKRAGAQAAGSTWLQGFGPPSVYHAAIVIFLEFFAWGLLTTPMLTVLHETFSQHTFLMNGLIQGVKGLLSFLSAPLIGALSDVWGRKPFLLGTVFFTCFPIPLMRISPCQA

SEQ ID NO: 10796 - protein, 115 aa, Artificial Sequence
  Description of Artificial Sequence: Synthetic coding sequence
MLGLLGSTALVGWITGAAVAVLLLLLLLATCLFHGRQDCDVERNRTAAGGNRVRRAQPWPFRRRGHLGIFHHHRHPGHVSHVPNVGLHHHHHPRHTPHHLHHHHHPHRHHPRHAR

SEQ ID NO: 10797 - protein, 346 aa, Artificial Sequence
  Description of Artificial Sequence: Synthetic coding sequence
MYNGSCCRIEGDTISQVMPPLLIVAFVLGALGNGVALCGFCFHMKTWKPSTVYLFNLAVADFLLMICLPFRTDYYLRRRHWAFGDIPCRVGLFTLAMNRAGSIVFLTVVAADRYFKVVHPHHAVNTISTRVAAGIVCTLWALVILGTVYLLLENHLCVQETAVSCESFIMESANGWHDIMFQLEFFMPLGIILFCSFKIVWSLRRRQQLARQARMKKATRFIMVVAIVFITCYLPSVSARLYFLWTVPSSACDPSVHGALHITLSFTYMNSMLDPLVYYFSSPSFPKFYNKLKICSLKPKQPGHSKTQRPEEMPISNLGRRSCISVANSFQSQSDGQWDPHIVEWH

SEQ ID NO: 10798 - protein, 346 aa, Artificial Sequence; identical to SEQ ID NO: 10797
  Description of Artificial Sequence: Synthetic coding sequence

SEQ ID NO: 10799 - protein, 346 aa, Artificial Sequence; identical to SEQ ID NO: 10797
  Description of Artificial Sequence: Synthetic coding sequence

SEQ ID NO: 10800 - protein, 363 aa, Artificial Sequence [sequence omitted]

SEQ ID NO: 10801 - protein, 387 aa, Artificial Sequence
  Description of Artificial Sequence: Synthetic coding sequence
MNRHHLQDHFLEIDKKNCCVFRDDFIVKVLPPVLGLEFIFGLLGNGLALWIFCFHLKSWKSSRIFLFNLAVADFLLIICLPFLMDNYVRRWDWKFGDIPCRLMLFMLAMNRQGSIIFLTVVAVDRYFRVVHPHHALNKISNRTAAIISCLLWGITIGLTVHLLKKKMPIQNGGANLCSSFSICHTFQWHEAMFLLEFFLPLGIILFCSARIIWSLRQRQMDRHAKIKRAITFIMVVAIVFVICFLPSVVVRIRIFWLLHTSGTQNCEVYRSVDLAFFITLSFTYMNSMLDPVVYYFSSPSFPNFFSTLINRCLQRKMTGEPDNNRSTSVELTGDPNKTRGAPEALMANSGEPWSPSYLGPTSNNHAKKGHCHQEPGSLEKQLGCCIE

SEQ ID NO: 10802 - protein, 317 aa, Artificial Sequence
  Description of Artificial Sequence: Synthetic coding sequence
MWLYLAAFVGLYYLLHWYRERQVVSHLQDKYVFITGCDSGFGNLLARQLDARGLRVLAACLTEKGAEQLRGQTSDRLETVTLDVTKMESIAAATQWVKEHVGDRGLWGLVNNAGILTPITLCEWLNTEDSMNMLKVNLIGVIQVTLSMLPLVRRARGRIVNVSSILGRVAFFVGGYCVSKYGVEAFSDILRREIQHFGVKISIVEPGYFRTGMTNMTQSLERMKQSWKEAPKHIKETYGQQYFDALYNIMKEGLLNCSTNLNLVTDCMEHALTSVHPRTRYSAGWDAKFFFIPLSYLPTSLADYILTRSWPKPAQAV

SEQ ID NO: 10803 - protein, 317 aa, Artificial Sequence; identical to SEQ ID NO: 10802
  Description of Artificial Sequence: Synthetic coding sequence

SEQ ID NO: 10804 - protein, 88 aa, Artificial Sequence
  Description of Artificial Sequence: Synthetic coding sequence
MWLYLAAFVGLYYLLHWYRERQVVSHLQDKYVFITGCDSGFGNLLARQLDARGLRVLAACLTEKGAEQLRGQTSDRLETVTLDVTKME

SEQ ID NO: 10805 - protein, 317 aa, Artificial Sequence; identical to SEQ ID NO: 10802
  Description of Artificial Sequence: Synthetic coding sequence

SEQ ID NO: 10806 - protein, 317 aa, Artificial Sequence; identical to SEQ ID NO: 10802
  Description of Artificial Sequence: Synthetic coding sequence

SEQ ID NO: 10807 - protein, 317 aa, Artificial Sequence; identical to SEQ ID NO: 10802
  Description of Artificial Sequence: Synthetic coding sequence

SEQ ID NO: 10808 - protein, 75 aa, Artificial Sequence
  Description of Artificial Sequence: Synthetic coding sequence
MWLYLAAFVGLYYLLHWYRERQVVSHLQDKYVFITGCDSGFGNLLARQLDARGLRVLAACLTEKGAEQLRGQTSD

SEQ ID NO: 10809 - protein, 330 aa, Artificial Sequence
  Description of Artificial Sequence: Synthetic coding sequence
MAAVDSFYLLYREIARSCNCYMEALALVGAWYTARKSITVICDFYSLIRLHFIPRLGSRADLIKQYGRWAVVSGATDGIGKAYAEELASRGLNIILISRNEEKLQVVAKDIADTYKVETDIIVADFSSGREIYLPIREALKDKDVGILVNNVGVFYPYPQYFTQLSEDKLWDIINVNIAAASLMVHVVLPGMVERKKGAIVTISSGSCCKPTPQLAAFSASKAYLDHFSRALQYEYASKGIFVQSLIPFYVATSMTAPSNFLHRCSWLVPSPKVYAHHAVSTLGISKRTTGYWSHSIQFLFAQYMPEWLWVWGANILNRSLRKEALSCTA

SEQ ID NO: 10810 - protein, 275 aa, Artificial Sequence
  Description of Artificial Sequence: Synthetic coding sequence
MAAVDSFYLLYREIARSCNCYMEALALVGAWYTARKSITVICDFYSLIRLHFIPRLGSRADLIKQYGRWAVVSGATDGIGKAYAEELASRGLNIILISRNEEKLQYFTQLSEDKLWDIINVNIAAASLMVHVVLPGMVERKKGAIVTISSGSCCKPTPQLAAFSASKAYLDHFSRALQYEYASKGIFVQSLIPFYVATSMTAPSNFLHRCSWLVPSPKVYAHHAVSTLGISKRTTGYWSHSIQFLFAQYMPEWLWVWGANILNRSLRKEALSCTA

SEQ ID NO: 10811 - protein, 890 aa, Artificial Sequence
  Description of Artificial Sequence: Synthetic coding sequence
MEGGGKPNSSSNSRDDGNSVFPAKASATGAGPAAAEKRLGTPPGGGGAGAKEHGNSVCFKVDGGGGGGGGGGGGEEPAGGFEDAEGPRRQYGFMQRQFTSMLQPGVNKFSLRMFGSQKAVEKEQERVKTAGFWIIHPYSDFRFYWDLIMLIMMVGNLVIIPVGITFFTEQTTTPWIIFNVASDTVFLLDLIMNFRTGTVNEDSSEIILDPKVIKMNYLKSWFVVDFISSIPVDYIFLIVEKGMDSEVYKTARALRIVRFTKILSLLRLLRLSRLIRYIHQWEEIFHMTYDLASAVVRIFNLIGMMLLLCHWDGCLQFLVPLLQDFPPDCWVSLNEMVNDSWGKQYSYALFKAMSHMLCIGYGAQAPVSMSDLWITMLSMIVGATCYAMFVGHATALIQSLDSSRRQYQEKYKQVEQYMSFHKLPADMRQKIHDYYEHRYQGKIFDEENILNELNDPLREEIVNFNCRKLVATMPLFANADPNFVTAMLSKLRFEVFQPGDYIIREGAVGKKMYFIQHGVAGVITKSSKEMKLTDGSYFGEICLLTKGRRTASVRADTYCRLYSLSVDNFNEVLEEYPMMRRAFETVAIDRLDRIGKKNSILLQKFQKDLNTGVFNNQENEILKQIVKHDREMVQAIAPINYPQMTTLNSTSSTTTPTSRMRTQSPPVYTATSLSHSNLHSPSPSTQTPQPSAILSPCSYTTAVCSPPVQSPLAARTFHYASPTASQLSLMQQQPQQQVQQSQPPQTQPQQPSPQPQTPGSSTPKNEVHKSTQALHNTNLTREVRPLSASQPSLPHEVSTLISRPHPTVGESLASIPQPVTAVPGTGLQAGGRSTVPQRVTLFRQMSSGAIPPNRGVPPAPPPPAAALPRESSSVLNTDPDAEKPRFASNL

SEQ ID NO: 10812 - protein, 389 aa, Artificial Sequence
  Description of Artificial Sequence: Synthetic coding sequence
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRARAFLAEVKQMRARRKTAKMLMVVLLVFALCYLPISVLNVLKRVFGMFRQASDREAVYACFTFSHWLVYANSAANPIIYNFLSGCKEKSLALSCPSCPGHDPHLAAALCS

SEQ ID NO: 10813 - protein, 425 aa, Artificial Sequence
  Description of Artificial Sequence: Synthetic coding sequence
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRARAFLAEVKQMRARRKTAKMLMVVLLVFALCYLPISVLNVLKRVFGMFRQASDREAVYACFTFSHWLVYANSAANPIIYNFLSGKFREQFKAAFSCCLPGLGPCGSLKAPSPRSSASHKSLSLQSRCSISKISEHVVLTSVTTVLP

SEQ ID NO: 10814 - protein, 425 aa, Artificial Sequence; identical to SEQ ID NO: 10813
  Description of Artificial Sequence: Synthetic coding sequence

SEQ ID NO: 10815 - protein, 444 aa, Artificial Sequence
  Description of Artificial Sequence: Synthetic coding sequence
MSGTKLEDSPPCRNWSSASELNETQEPFLNPTDYDDEEFLRYLWREYLHPKEYEWVLIAGYIIVFVVALIGNVLVCVAVWKNHHMRTVTNYFIVNLSLADVLVTITCLPATLVVDITETWFFGQSLCKVIPYLQTVSVSVSVLTLSCIALDRWYAICHPLMFKSTAKRARNSIVIIWIVSCIIMIPQAIVMECSTVFPGLANKTTLFTVCDERWGGEIYPKMYHICFFLVTYMAPLCLMVLAYLQIFRKLWCRQIPGTSSVVQRKWKPLQPVSQPRGPGQPTKSRMSAVAAEIKQIRARRKTARMLMIVLLVFAICYLPISILNVLKRVFGMFAHTEDRETVYAWFTFSHWLVYANSAANPIIYNFLSGKFREEFKAAFSCCCLGVHHRQEDRLTRGRTSTESRKSLTTQISNFDNISKLSEQVVLTSISTLPAANGAGPLQNW

SEQ ID NO: 10816 - protein, 377 aa, Artificial Sequence
  Description of Artificial Sequence: Synthetic coding sequence
MSEVKSRKKSGPKGAPAAEPGKRSEGGKTPVARSSGGGGWADPRTCLSLLSLGTCLGLAWFVFQQSEKFAKVENQYQLLKLETNEFQQLQSKISLISEKLESTESILQEATSSMSLMTQFEQEVSNLQDIMHDIQNNEEVLTQRMQSLNEKFQNITDFWKRSLEEMNINTDIFKSEAKHIHSQVTVQINSAEQEIKLLTERLKDLEDSTLRNIRTVKRQEEEDLLRVEEQLGSDTKAIEKLEEEQHALFARDEDLTNKLSDYEPKVEECKTHLPTIESAIHSVLRVSQDLIETEKKMEDLTMQMFNMEDDMLKAVSEIMEMQKTLEGIQYDNSILKMQNELDILKEKVHDFIAYSSTGEKGTLKEYNIENKGIGGDF

SEQ ID NO: 10817 - protein, 350 aa, Artificial Sequence
  Description of Artificial Sequence: Synthetic coding sequence
MSEVKSRKKSGPKGAPAAEPGKRSEGGKTPVARSSGGGGWADPRTCLSLLSLGTCLGLAWFVFQQSEKFAKVENQYQLLKLETNEFQQLQSKISLISEKWQKSEAIMEQLKSFQIIAHLKRLQEEINEVKTWSNRITEKQDILNNSLTTLSQDITKVDQSTTSMAKDVGLKITSVKTDIRRISGLVTDVISLTDSVQELENKIEKVEKNTVKNIGDLLSSSIDRTATLRKTASENSQRINSVKKTLTELKSDFDKHTDRFLSLEGDRAKVLKTVTFANDLKPKVYNLKKDFSRLEPLVNDLTLRIGRLVTDLLQREKEIAFLSEKISNLTIVQAEIKDIKDEIAHISDMN

SEQ ID NO: 10818 - protein, 70 aa, Artificial Sequence
  Description of Artificial Sequence: Synthetic coding sequence
MSEVKSRKKSGPKGAPAAEPGKRSEGGKTPVARSSGGGGWADPRTCLSLLSLGTCLGLACGRNLKLSWNN

SEQ ID NO: 10819 - protein, 244 aa, Artificial Sequence
  Description of Artificial Sequence: Synthetic coding sequence
MEQLKSFQIIAHLKRLQEEINEVKTWSNRITEKQDILNNSLTTLSQDITKVDQSTTSMAKDVGLKITSVKTDIRRISGLVTDVISLTDSVQELENKIEKVEKNTVKNIGDLLSSSIDRTATLRKTASENSQRINSVKKTLTELKSDFDKHTDRFLSLEGDRAKVLKTVTFANDLKPKVYNLKKDFSRLEPLVNDLTLRIGRLVTDLLQREKEIAFLSEKISNLTIVQAEIKDIKDEIAHISDMN

SEQ ID NO: 10820 - protein, 814 aa, Artificial Sequence
  Description of Artificial Sequence: Synthetic coding sequence
MAVQRAASPRRPPAPLWPRLLLPLLLLLLPAPSEGLGHSAELAFAVEPSDDVAVPGQPIVLDCRVEGTPPVRITWRKNGVELPESTHSTLLANGSLMIRHFRLEPGGSPSDEGDYECVAQNRFGLVVSRKARIQAATMSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTGIVIGIHIGVTCIIFCVLFLLFGQRGRVLLCKDVENQLSPPQGPRSQRDPGILALNGARRGQRGQLGRDEKRVDMKELEQLFPPASAAGQPDPRPTQDPAAPAPCEETQLSVLPLQGCGLMEGKTTEAKTTEATAPCAGLAAAPPPPDGGPGLLSEGQASRPAAARVTQPAHSEQ

SEQ ID NO: 10821 - protein, 637 aa, Artificial Sequence
  Description of Artificial Sequence: Synthetic coding sequence
MSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTGIVIGIHIGVTCIIFCVLFLLFGQRGRVLLCKDVDMKELEQLFPPASAAGQPDPRPTDPAAPAPCEETQLSVLPLQGCGLMEGKTTEAKTTEATAPCAGLAAAPPPPDGGPGLLSEGQASRPAAARVTQPAHSEQ

SEQ ID NO: 10822 - protein, 1250 aa, Artificial Sequence
  Description of Artificial Sequence: Synthetic coding sequence
MARGDAGRGRGLLALTFCLLAARGELLLPQETTVELSCGVGPLQVILGPEQAAVLNCSLGAAAAGPPTRVTWSKDGDTLLEHDHLHLLPNGSLWLSQPLAPNGSDESVPEAVGVIEGNYSCLAHGPLGVLASQTAVVKLATLADFSLHPESQTVEENGTARFECHIEGLPAPIITWEKDQVTLPEEPRLIVLPNGVLQILDVQESDAGPYRCVATNSARQHFSQEALLSVAHRGSLASTRGQDVVIVAAPENTTVVSGQSVVMECVASADPTPFVSWVRQDGKPISTDVIVLGRTNLLIANAQPWHSGVYVCRANKPRTRDFATAAAELRVLAAPAITQAPEALSRTRASTARFVCRASGEPRPALRWLHNGAPLRPNGRVKVQGGGGSLVITQIGLQDAGYYQCVAENSAGMACAAASLAVVVREGLPSAPTRVTATPLSSSAVLVAWERPEMHSEQIIGFSLHYQKARGMDNVEYQFAVNNDTTELQVRDLEPNTDYEFYVVAYSQLGASRTSTPALVHTLDDVPSAAPQLSLSSPNPSDIRVAWLPLPPSLSNGQVVKYKIEYGLGKEDQIFSTEVRGNETQLMLNSLQPNKVYRVRISAGTAAGFGAPSQWMHHRTPSMHNQSHVPFAPAELKVQAKMESLVVSWQPPPHPTQISGYKLYWREVGAEEEANGDRLPGGRGDQAWDVGPVRLKKKVKQYELTQLVPGRLYEVKLVAFNKHEDGYAAVWKGKTEKAPAPDMPIQRGPPLPPAHVHAESNSSTSIWLRWKKPDFTTVKIVNYTVRFSPWGLRNASLVTYYTSSGEDILIGGLKPFTKYEFAVQSHGVDMDGPFGSVVERSTLPDRPSTPPSDLRLSPLTPSTVRLHWCPPTEPNGEIVEYLILYSSNHTQPEHQWTLLTTQGNIFSAEVHGLESDTRYFFKMGARTEVGPGPFSRLQDVITLQEKLSDSLDMHSVTGIIVGVCLGLLCLLACMCAGLRRSPHRESLPGLSSTATPGNPALYSRARLGPPSPPAAHELESLVHPHPQDWSPPPSDVEDRAEVHSLMGGGVSEGRSHSKRKISWAQPSGLSWAGSWAGCELPQAGPRPALTRALLPPAGTGQTLLLQALVYDAIKGNGRKKSPPACRNQVEAEVIVHSDFSASNGNPDLHLQDLEPEDPLPPEAPDLISGVGDPGQGAAWLDRELGGCELAAPGPDRLTCLPEAASASCSYPDLQPGEVLEETPGDSCQLKSPCPLGASPGLPRSPVSSSA

SEQ ID NO: 10823 - protein, 979 aa, Artificial Sequence
  Description of Artificial Sequence: Synthetic coding sequence
MGRRKGRSALSRSSLERVNQGEVKVIGRGAREGGGGQAWGTGGGRDLSCGIPRSASPLAPLAAPAITQAPEALSRTRASTARFVCRASGEPRPALRWLHNGAPLRPNGRVKVQGGGGSLVITQIGLQDAGYYQCVAENSAGMACAAASLAVVVREGLPSAPTRVTATPLSSSAVLVAWERPEMHSEQIIGFSLHYQKARGMDNVEYQFAVNNDTTELQVRDLEPNTDYEFYVVAYSQLGASRTSTPALVHTLDDVPSAAPQLSLSSPNPSDIRVAWLPLPPSLSNGQVVKYKIEYGLGKEDQIFSTEVRGNETQLMLNSLQPNKVYRVRISAGTAAGFGAPSQWMHHRTPSMHNQSHVPFAPAELKVQAKMESLVVSWQPPPHPTQISGYKLYWREVGAEEEANGDRLPGGRGDQAWDVGPVRLKKKVKQYELTQLVPGRLYEVKLVAFNKHEDGYAAVWKGKTEKAPAPDMPIQRGPPLPPAHVHAESNSSTSIWLRWKKPDFTTVKIVNYTVRFSPWGLRNASLVTYYTSSGEDILIGGLKPFTKYEFAVQSHGVDMDGPFGSVVERSTLPDRPSTPPSDLRLSPLTPSTVRLHWCPPTEPNGEIVEYLILYSSNHTQPEHQWTLLTTQGNIFSAEVHGLESDTRYFFKMGARTEVGPGPFSRLQDVITLQEKLSDSLDMHSVTGIIVGVCLGLLCLLACMCAGLRRSPHRESLPGLSSTATPGNPALYSRARLGPPSPPAAHELESLVHPHPQDWSPPPSDVEDRAEVHSLMGGGVSEGRSHSKRKISWAQPSGLSWAGSWAGCELPQAGPRPALTRALLPPAGTGQTLLLQALVYDAIKGNGRKKSPPACRNQVEAEVIVHSDFSASNGNPDLHLQDLEPEDPLPPEAPDLISGVGDPGQGAAWLDRELGGCELAAPGPDRLTCLPEAASASCSYPDLQPGEVLEETPGDSCQLKSPCPLGASPGLPRSPVSSSA

SEQ ID NO: 10824 - protein, 430 aa, Artificial Sequence
  Description of Artificial Sequence: Synthetic coding sequence
MSLVELLLWWNCFSRTGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 10825 - protein, 431 aa, Artificial Sequence
  Description of Artificial Sequence: Synthetic coding sequence
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 10826 - protein, 430 aa, Artificial Sequence; identical to SEQ ID NO: 10824
  Description of Artificial Sequence: Synthetic coding sequence

SEQ ID NO: 10827 - protein, 192 aa, Artificial Sequence
  Description of Artificial Sequence: Synthetic coding sequence
MRAKPQSPLPRNPVPAWSPPTTTTDPMLEKDAAGGDFPANLVLQLMPLKTFPAAIRGVIQSELNYSVILQWVVTMDPEPVLSWTFSGVPCGMGEKLFIRRLSCEQLGTYMCIATNSKKQLVSEPVTISLPKPIMQPTEAEPMEPDPTLSLSGGSAIGLLAAGILGAGALIAGMCFIIIQSLRTDRQRIGICS

SEQ ID NO: 10828 - protein, 407 aa, Artificial Sequence
  Description of Artificial Sequence: Synthetic coding sequence
MGQKERSTADTLPDLEEWKSAAGLRWWQTAVVDGSGSGNEVIEGPQNARVLKGSQARFNCTVSQGWKLIMWALSDMVVLSVRPMEPIITNDRFTSQRYDQGGNFTSEMIIHNVEPSDSGNIRCSLQNSRLHGSAYLTVQVMGELFIPSVNLVVAENEPCEVTCLPSHWTRLPDISWELGLLVSHSSYYFVPEPSDLQSAVSILALTPQSNGTLTCVATWKSLKARKSATVNLTVIRCPQDTGGGINIPGVLSSLPSLGFSLPTWGKVGLGLAGTMLLTPTCTLTIRCCCCRRRCCGCNCCCRCCFCCRRKRGFRIQFQKKSEKEKTNKETETESGNENSGYNSDEQKTTDTASLPPKSCESSDPEQRNSSCGPPHQRADQRPPRPASHPQASFNLASPEKVSNTTVV

SEQ ID NO: 10829 - protein, 639 aa, Artificial Sequence
  Description of Artificial Sequence: Synthetic coding sequence
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 10830 - protein, 547 aa, Artificial Sequence
  Description of Artificial Sequence: Synthetic coding sequence
MAMGLFRVCLVVVTAIINHPLLFPRENATVPENEEEIIRKMQAHQEKLQLEQLRLEEEVARLAAEKEALEQVAEEGRQQNETRVAWDLWSTLCMILFLMIEVWRQDHQEGPSPECLGGEEDELPGLGGAPLQGLTLPNKATLGHFYERCIRGATADAARTREFLEGFVDDLLEALRSLCNRDTDMEVEDFIGVDSMYENWQVDRPLLCHLFVPFTPPEPYRFHPELWCSGRSVPLDRQGYGQIKVVRADGDTLSCICGKTKLGEDMLCLLHGRNSMAPPCGDMENLLCATDSLYLDTMQVMKWFQTALTRAWKGIAHKYEFDLAFGQLDSPGSLKIKFRSGKFMPFNLIPVIQCDDSDLYFVSHLPREPSEGTPASSTDWLLSFAVYERHFLRTTLKALPEGACHLSCLQIASFLLSKQSRLTGPSGLSSYHLKTALLHLLLLRQAADWKAGQLDARLHELLCFLEKSLLQKKLHHFFIGNRKVPEAMGLPEAVLRAEPLNLFRPFVLQRSLYRKTLDSFYEMLKNAPALISEYSLHVPSDQPTPKS

SEQ ID NO: 10831 - protein, 547 aa, Artificial Sequence; identical to SEQ ID NO: 10830
  Description of Artificial Sequence: Synthetic coding sequence

SEQ ID NO: 10832 - protein, 547 aa, Artificial Sequence; identical to SEQ ID NO: 10830
  Description of Artificial Sequence: Synthetic coding sequence

SEQ ID NO: 10833 - protein, 114 aa, Artificial Sequence
  Description of Artificial Sequence: Synthetic coding sequence
MAMGLFRVCLVVVTAIINHPLLFPRENATVPENEEEIIRKMQAHQEKLQLEQLRLEEEVARLAAEKEALEQVAEEGRQQNETRVAWDLWSTLCMILFLMIEVWRQDHQEGPSPE

SEQ ID NO: 10834 - protein, 563 aa, Artificial Sequence
  Description of Artificial Sequence: Synthetic coding sequence
MTTDSYSPTSPDAEASMAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 10835 - protein, 555 aa, Artificial Sequence
  Description of Artificial Sequence: Synthetic coding sequence
MNVDAEASMAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 10836 - protein, 547 aa, Artificial Sequence
  Description of Artificial Sequence: Synthetic coding sequence
MAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 10837 - protein, 547 aa, Artificial Sequence; identical to SEQ ID NO: 10836
  Description of Artificial Sequence: Synthetic coding sequence

SEQ ID NO: 10838 - protein, 535 aa, Artificial Sequence
  Description of Artificial Sequence: Synthetic coding sequence
MSVHYTLNLRVFWPLVTGLCTALVCLYHVLRGSGGARAEPADGVDGGFPLLKVAVLLLLSYVLLRCRHAVRQRFLPGSPRLEGHAAFSSRHFREPGLSILLESYYEHEVRLSPHVLGHSKAHVSRIVGELVRAGRARGSPGLIPGGALALAFRGDFIQVGSAYEQHKIRRPDSFDVLVPLRLPPLVALEPRSLGEEPALAPAFRGCFLCALKAPPSPSGASGGHWLRDCKPFADAFCVDVRGRRHLSATLVLRWFQSHLQRSLATVRYSLEGRCRVTLTPGGLEQPPTLHILPCRTDYGCCRLSMAVRLIPAVHLGDGVFLVAPPPPPLPSAPLLELPEGLRAEALWGVNTARQEQKLLSWLQERAAPGACYLKCLQLLKALRDLGARGLDSAAATQWGRILSSYVLKTVLLAVLLRKGAPGQGWDEEHLGRCLEELVQFLRDCLLRRHTLFHCVLGPGGAAAEVGPLPKALREAAPVDLLAAFDGHARELAAARLLSTWQRLPQLLRAYGGPRYLARCPPPRSQRTQGFLEGEP

SEQ ID NO: 10839 - protein, 1257 aa, Artificial Sequence
  Description of Artificial Sequence: Synthetic coding sequence
MASCSFTRDQATRRLRGAAAAAAAALAAVVTTPLLSSGTPTALIGTGSSCPGAMWLSTATGSRSDSESEEEDLPVGEEVCKRGYLRKQKHGHRRYFVLKLETADAPARLEYYENARKFRHSVRAAAAAAAAAASGAAIPPLIPPRRVITLYQCFSVSQRADARYRHLIALFTQDEYFAMVAENESEQESWYLLLSRLILESKRRRCGTLGAQPDGEPAALAAAAAAEPPFYKDVWQVIVKPRGLGHRKELSGVFRLCLTDEEVVFVRLNTEVASVVVQLLSIRRCGHSEQYFFLEVGRSTVIGPGELWMQVDDCVVAQNMHELFLEKMRALCADEYRARCRSYSISIGAHLLTLLSARRHLGLVPLEPGGWLRRSRFEQFCHLRAIGDGEDEMLFTRRFVTPSEPVAHSRRGRLHLPRGRRSRRAVSVPASFFRRLAPSPARPRHPAEAPNNGARLSSEVSGSGSGNFGEEGNPQGKEDQEGSGGDYMPMNNWGSGNGRGSGGGQGSNGQGSSSHSSGGNQCSGEGQGSRGGQGSNGQGSGGNQCSRDGQGTAGGHGSGGGQRPGGGHGSGGGQGPGDGHGSGGGKNSGGGKGSGSGKGSDGDGERGKSLKKRSYFGKLTQSKQQQMPPPPPPPPPPPPAGGTGGKGKSGGRFRLYFCVDRGATKECKEAKEVKDAEIPEGAARGPHRARAFDEDEDDPYVPMRPGVATPLVSSSDYMPMAPQNVSASKKRHSRSPFEDSRGYMMMFPRVSPPPAPSPPKAPDTNKEDDSKDNDSESDYMFMAPGAGAIPKNPRNPQGGSSSKSWSSYFSLPNPFRSSPLGQNDNSEYVPMLPGKFLGRGLDKEVSYNWDPKDAASKPSGEGSFSKPGDGGSPSKPSDHEPPKNKAKRPNRLSFITKGYKIKPKPQKPTHEQREADSSSDYVNMDFTKRESNTPAPSTQGLPDSWGIIAEPRQSAFSNYVNVEFGVPFPNPANDLSDLLRAIPRANPLSLDSARWPLPPLPLSATGSNAIEEEGDYIEVIFNSAMTPAMALADSAIRYDAETGRIYVVDPFSECCMDISLSPSRCSEPPPVARLLQEEEQERRRPQSRSQSFFAAARAAVSAFPTDSLERDLSPSSAPAVASAAEPTLALSQVVAAASALAAAPGIGAAAAAAGFDSASARWFQPVANAADAEAVRGAQDVAGGSNPGAHNPSANLARGDNQAGGAAAAAAAPEPPPRSRRVPRPPEREDSDNDDDTHVRMDFARRDNQFDSPKRGR

SEQ ID NO: 10840 - protein, 2394 aa, Artificial Sequence
  Description of Artificial Sequence: Synthetic coding sequence
MWLSGKSQVQKRGAVRYLQAPPVNGEASACPAPPTHLDRTTCARRRPARLPPPWGAAGIRPAPRASRASFWARFPPHCFPSGCSGSRVLEGGEIGFRFRGGRVAAAALRSRWARGDAAAAGSREGRGRMNRAKPTTVRRPSAAAKPSGHPPPGDFIALGSKGQANESKTASTLLKPAPSGLPSERKRDAAAALSSASALTGLTKRPKLSSTPPLSALGRLAEAAVAEKRAISPSIKEPSVVPIEVLPTVLLDEIEAAELEGNDDRIEGVLCGAVKQLKVTRAKPDSTLYLSLMYLAKIKPNIFATEGVIEALCSLLRRDASINFKAKGNSLVSVLACNLLMAAYEEDENWPEIFVKVYIEDSLGERIWVDSPHCKTFVDNIQTAFNTRMPPRSVLLQGEAGRVAGDLGAGSSPHPSLTEEEDSQTELLIAEEKLSPEQEGQLMPRYEELAESVEEYVLDMLRDQLNRRQPIDNVSRNLLRLLTSTCGYKEVRLLAVQKLEMWLQNPKLTRPAQDLLMSVCMNCNTHGSEDMDVISHLIKIRLKPKVLLNHFMLCIRELLSAHKDNLGTTIKLVIFNELSSARNPNNMQVLYTALQHSSELAPKFLAMVFQDLLTNKDDYLRASRALLREIIKQTKHEINFQAFCLGLMQERKEPQYLEMEFKERFVVHITDVLAVSMMLGITAQVKEAGIAWDKGEKRNLEVLRSFQNQIAAIQRDAVWWLHTVVPSISKLAPKDYVHCLHKVLFTEQPETYYKWDNWPPESDRNFFLRLCSEVPILEDTLMRILVIGLSRELPLGPADAMELADHLVKRAAAVQADDVEVLKVGRTQLIDAVLNLCTYHHPENIQLPPGYQPPNLAISTLYWKAWPLLLVVAAFNPENIGLAAWEEYPTLKMLMEMVMTNNYSYPPCTLTDEETRTEMLNRELQTAQREKQEILAFEGHLAAASTKQTITESSSLLLSQLTSLDPQYAAHTAPPCACRRDLGPPRRPPPHILDQVKSLNQSLRLGHLLCRSRNPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGETLPALPKAGPAHECLPQGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKSKMPGTCGVGSHTLTEPQPGQAFGAWVRAGVTLLRFADYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQAGLGRKRREELVLRVQGPELISLVELILAEAETRSQDGDTAACSLIQARLPLLLSCCCGDDESVRKVTEHLSGCIQQWGDSVLGRRCRDLLLQLYLQRPELRVPVPEVLLHSEGAASSSVCKLDGLIHRFITLLADTSDSRALENRGADASMACRKLAVAHPLLLLRHLPMIAALLHGRTHLNFQEFRQQNHLSCFLHVLGLLELLQPHVFRSEHQGALWDCLLSFIRLLLNYRKSSRHLAAFINKFVQFIHKYITYNAPAAISFLQKHADPLHDLSFDNSDLVMLKSLLAGLSLPSRDDRTDRGLDEEGEEESSAGSLPLVSVSLFTPLTAAEMAPYMKRLSRGQTVEDLLEVLSDIDEMSRRRPEILSFFSTNLQRLMSSAEECCRNLAFSLALRSMQNSPSIAAAFLPTFMYCLGSQDFEVVQTALRNLPEYALLCQEHAAVLLHRAFLVGMYGQMDPSAQISEALRILHMEAVM

SEQ ID NO: 10841 - protein, 2190 aa, Artificial Sequence
  Description of Artificial Sequence: Synthetic coding sequence
MNRAKPTTVRRPSAAAKPSGHPPPGDFIALGSKGQANESKTASTLLKPAPSGLPSERKRDAAAALSSASALTGLTKRPKLSSTPPLSALGRLAEAAVAEKRAISPSIKEPSVVPIEVLPTVLLDEIEAAELEGNDDRIEGVLCGAVKQLKVTRAKPDSTLYLSLMYLAKIKPNIFATEGVIEALCSLLRRDASINFKAKGNSLVSVLACNLLMAAYEEDENWPEIFVKVYIEDSLGERIWVDSPHCKTFVDNIQTAFNTRMPPRSVLLQGEAGRVAGDLGAGSSPHPSLTEEEDSQTELLIAEEKLSPEQEGQLMPRYEELAESVEEYVLDMLRDQLNRRQPIDNVSRNLLRLLTSTCGYKEVRLLAVQKLEMWLQNPKLTRPAQDLLMSVCMNCNTHGSEDMDVISHLIKIRLKPKVLLNHFMLCIRELLSAHKDNLGTTIKLVIFNELSSARNPNNMQVLYTALQHSSELAPKFLAMVFQDLLTNKDDYLRASRALLREIIKQTKHEINFQAFCLGLMQERKEPQYLEMEFKERFVVHITDVLAVSMMLGITAQVKEAGIAWDKGEKRNLEVLRSFQNQIAAIQRDAVWWLHTVVPSISKLAPKDYVHCLHKVLFTEQPETYYKWDNWPPESDRNFFLRLCSEVPILEDTLMRILVIGLSRELPLGPADAMELADHLVKRAAAVQADDVEVLKVGRTQLIDAVLNLCTYHHPENIQLPPGYQPPNLAISTLYWKAWPLLLVVAAFNPENIGLAAWEEYPTLKMLMEMVMTNNYSYPPCTLTDEETRTEMLNRELQTAQREKQEILAFEGHLAAASTKQTITESSSLLLSQLTSLDPQGPPRRPPPHILDQVKSLNQSLRLGHLLCRSRNPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKNYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQKRREELVLRVQGPELISLVELILAEAETRSQDGDTAACSLIQARLPLLLSCCCGDDESVRKVTEHLSGCIQQWGDSVLGRRCRDLLLQLYLQRPELRVPVPEVLLHSEGAASSSVCKLDGLIHRFITLLADTSDSRALENRGADASMACRKLAVAHPLLLLRHLPMIAALLHGRTHLNFQEFRQQNHLSCFLHVLGLLELLQPHVFRSEHQGALWDCLLSFIRLLLNYRKSSRHLAAFINKFVQFIHKYITYNAPAAISFLQKHADPLHDLSFDNSDLVMLKSLLAGLSLPSRDDRTDRGLDEEGEEESSAGSLPLVSVSLFTPLTAAEMAPYMKRLSRGQTVEDLLEVLSDIDEMSRRRPEILSFFSTNLQRLMSSAEECCRNLAFSLALRSMQNSPSIAAAFLPTFMYCLGSQDFEVVQTALRNLPEYALLCQEHAAVLLHRAFLVGMYGQMDPSAQISEALRILHMEAVM

SEQ ID NO: 10842 - protein, 1203 aa, Artificial Sequence
  Description of Artificial Sequence: Synthetic coding sequence
KDQQTVIMTECTSLQFVSPFAFEAMQKVDVVCLASLSDPELRLLLPCLVRMALCAPADQSQSWAQDKKLILRLLSGVEAVNSIVALLSVDFHALEQDASKEQQLRHKLGGGSGESILVSQLQHGLTLEFEHSDSPRRLRLVLSELLAIMNKVSESNGEFFFKSSELFESPVYLEEAADVLCILQAELPSLLPIVDVAEALLHVRNGAWFLCLLVANVPDSFNEVCRGLIKNGERQDEESLGGRRRTDALRFLCKMNPSQALKVRGMVVEECHLPGLGVALTLDHTKNEACEDGVSDLVCFVSGLLLGTNAKVRTWFGTFIRNGQQRKRETSSSVLWQMRRQLLLELMGILPTVRSTRIVEEADVDMEPNVSVYSGLKEEHVVKASALLRLYCALMGIAGLKPTEEEAEQLLQLMTSRPPATPAGVRFVSLSFCMLLAFSTLVSTPEQEQLMVVWLSWMIKEEAYFESTSGVSASFGEMLLLVAMYFHSNQLSAIIDLVCSTLGMKIVIKPSSLSRMKTIFTQEIFTEQVVTAHAVRVPVTSNLSANITGFLPIHCIYQLLRSRSFTKHKVSIKDWIYRQLCETSTPLHPQLLPLIDVYINSILTPASKSNPEATNQPVTEQEILNIFQGVIGGDNIRLNQRFSITAQLLVLYYILSYEEALLANTKTLAAMQRKPKSYSSSLMDQIPIKFLIRQAQGLQQELGGLHSALLRLLATNYPHLCIVDDWICEEEITGTDALLRRMLLTNNAKNHSPKQLQEAFSAVPVNNTQVMQIIEHLTLLSASELIPYAEVLTSNMSQLLNSGVPRRILQTVNKLWMVLNTVMPRRLWVMTVNALQPSIKFVRQQKYTQNDLMIDPLIVLRCDQRVHRCPPLMDITLHMLNGYLLASKAYLSAHLKETEQDRPSQNNTIGLVGQTDAPEVTREELKNALLAAQDSAAVQILLEICLPTEEEKANGVNPDSLLRNVQSVITTSAPNKGMEEGEDNLLCNLREVQCLICCLLHQMYIADPNIAKLVHFQGYPCELLPLTVAGIPSMHICLDFIPELIAQPELEKQIFAIQLLSHLCIQYALPKSLSVARLAVNVMGTLLTVLTQAKRYAFFMPTLPSLVSFCRAFPPLYEDIMSLLIQIGQVCASDVATQTRDIDPIITRLQQIKEKPSGWSQICKDSSYKNGSRDTGSMDPDVQLCHCIERTVIEIINMSVSGI

SEQ ID NO: 10843 - protein, 1204 aa, Artificial Sequence
  Description of Artificial Sequence: Synthetic coding sequence
MKDQQTVIMTECTSLQFVSPFAFEAMQKVDVVCLASLSDPELRLLLPCLVRMALCAPADQSQSWAQDKKLILRLLSGVEAVNSIVALLSVDFHALEQDASKEQQLRHKLGGGSGESILVSQLQHGLTLEFEHSDSPRRLRLVLSELLAIMNKVSESNGEFFFKSSELFESPVYLEEAADVLCILQAELPSLLPIVDVAEALLHVRNGAWFLCLLVANVPDSFNEVCRGLIKNGERQDEESLGGRRRTDALRFLCKMNPSQALKVRGMVVEECHLPGLGVALTLDHTKNEACEDGVSDLVCFVSGLLLGTNAKVRTWFGTFIRNGQQRKRETSSSVLWQMRRQLLLELMGILPTVRSTRIVEEADVDMEPNVSVYSGLKEEHVVKASALLRLYCALMGIAGLKPTEEEAEQLLQLMTSRPPATPAGVRFVSLSFCMLLAFSTLVSTPEQEQLMVVWLSWMIKEEAYFESTSGVSASFGEMLLLVAMYFHSNQLSAIIDLVCSTLGMKIVIKPSSLSRMKTIFTQEIFTEQVVTAHAVRVPVTSNLSANITGFLPIHCIYQLLRSRSFTKHKVSIKDWIYRQLCETSTPLHPQLLPLIDVYINSILTPASKSNPEATNQPVTEQEILNIFQGVIGGDNIRLNQRFSITAQLLVLYYILSYEEALLANTKTLAAMQRKPKSYSSSLMDQIPIKFLIRQAQGLQQELGGLHSALLRLLATNYPHLCIVDDWICEEEITGTDALLRRMLLTNNAKNHSPKQLQEAFSAVPVNNTQVMQIIEHLTLLSASELIPYAEVLTSNMSQLLNSGVPRRILQTVNKLWMVLNTVMPRRLWVMTVNALQPSIKFVRQQKYTQNDLMIDPLIVLRCDQRVHRCPPLMDITLHMLNGYLLASKAYLSAHLKETEQDRPSQNNTIGLVGQTDAPEVTREELKNALLAAQDSAAVQILLEICLPTEEEKANGVNPDSLLRNVQSVITTSAPNKGMEEGEDNLLCNLREVQCLICCLLHQMYIADPNIAKLVHFQGYPCELLPLTVAGIPSMHICLDFIPELIAQPELEKQIFAIQLLSHLCIQYALPKSLSVARLAVNVMGTLLTVLTQAKRYAFFMPTLPSLVSFCRAFPPLYEDIMSLLIQIGQVCASDVATQTRDIDPIITRLQQIKEKPSGWSQICKDSSYKNGSRDTGSMDPDVQLCHCIERTVIEIINMSVSGI

SEQ ID NO: 10844 - protein, 1019 aa, Artificial Sequence
  Description of Artificial Sequence: Synthetic coding sequence
MSALCDPPGAPGPPGPAPATHGPAPLSAQELSQEIKAFLTGVDPILGHQLSAREHARCGLLLLRSLPPARAAVLDHLRGVFDESVRAHLAALDETPVAGPPHLRPPPPSHVPAGGPGLEDVVQEVQQVLSEFIRANPKAWAPVISAWSIDLMGQLSSTYSGQHQRVPHATGALNELLQLWMGCRATRTLMDIYVQCLSALIGSCPDACVDALLDTSVQHSPHFDWVVAHIGSSFPGTIISRVLSCGLKDFCVHGGAGGGAGSSGGSSSQTPSTDPFPGSPAIPAEKRVPKIASVVGILGHLASRHGDSIRRELLRMFHDSLAGGSGGRSGDPSLQATVPFLLQLAVMSPALLGTVSGELVDCLKPPAVLSQLQQHLQGFPREELDNMLNLAVHLVSQASGAGAYRLLQFLVDTAMPASVITTQGLAVPDTVREACDRLIQLLLLHLQKLVHHRGGSPGEGVLGPPPPPRLVPFLDALKNHVGELCGETLRLERKRFLWQHQLLGLLSVYTRPSCGPEALGHLLSRARSPEELSLATQLYAGLVVSLSGLLPLAFRSCLARVHAGTLQPPFTARFLRNLALLVGWEQQGGEGPAALGAHFGESASAHLSDLAPLLLHPEEEVAEAAASLLAICPFPSEALSPSQLLGLVRAGVHRFFASLRLHGPPGVASACQLLTRLSQTSPAGLKAVLQLLVEGALHRGNTELFGGQVDGDNETLSVVSASLASASLLDTNRRHTAAVPGPGGIWSVFHAGVIGRGLKPPKFVQSRNQQEVIYNTQSLLSLLVHCCSAPGGTECGECWGAPILSPEAAKAVAVTLVESVCPDAAGAELAWPPEEHARATVERDLRIGRRFREQPLLFELLKLVAAAPPALCYCSVLLRGLLAALLGHWEASRHPDTTHSPWHLEASCTLVAVMAEGSLLPPALGNMHEVFSQLAPFEVRLLLLSVWGFLREHGPLPQKFIFQSERGRFIRDFSREGGGEGGPHLAVLHSVLHRNIDRLGLFSGRFQAPSPSTLLRQGT

SEQ ID NO: 10845 - protein, 552 aa, Artificial Sequence
  Description of Artificial Sequence: Synthetic coding sequence
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVIKHKVRDLVPSSRVVRLGEGGPDSDQAIRDRFSRLRYQSEA

SEQ ID NO: 10846 - protein, 552 aa, Artificial Sequence; identical to SEQ ID NO: 10845
  Description of Artificial Sequence: Synthetic coding sequence

SEQ ID NO: 10847 - protein, 69 aa, Artificial Sequence
  Description of Artificial Sequence: Synthetic coding sequence
MLDHKDLEAEIHPLKNEERKSQENLGNPSKNEDNVKSAPPQSRLSRCRAAAFFLSLFLCLFVVFVVSFV

SEQ ID NO: 10848 - protein, 102 aa, Artificial Sequence
  Description of Artificial Sequence: Synthetic coding sequence
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDING

SEQ ID NO: 10849 - protein, 233 aa, Artificial Sequence
  Description of Artificial Sequence: Synthetic coding sequence
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQE

SEQ ID NO: 10850 - protein, 51 aa, Artificial Sequence
  Description of Artificial Sequence: Synthetic coding sequence
MLDHKDLEAEIHPLKNEERKSQENLGNPSKNEDNVKSAPPQSRLSRCRAAA

SEQ ID NO: 10851 - protein, 531 aa, Artificial Sequence
  Description of Artificial Sequence: Synthetic coding sequence
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDGSHWATAERLLDGAELAPRPACPRLVTGVWEAARLCILLPGIRWLIYWF

SEQ ID NO: 10852 - protein, 87 aa, Artificial Sequence
  Description of Artificial Sequence: Synthetic coding sequence
MLDHKDLEAEIHPLKNEERKSQENLGNPSKNEDNVKSAPPQSRLSRCRAAAFFLSLFLCLFVVFVVSFVIPCPDRPASQRMWRIDYS

SEQ ID NO: 10853 - protein, 540 aa, Artificial Sequence
  Description of Artificial Sequence: Synthetic coding sequence
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVIKHKAHTGRQRRGSWTGQSSRRDLHVRVL

SEQ ID NO: 10854 - protein, 236 aa, Artificial Sequence
  Description of Artificial Sequence: Synthetic coding sequence
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREE

SEQ ID NO: 10855 - protein, 1167 aa, Artificial Sequence
  Description of Artificial Sequence: Synthetic coding sequence
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 10856 - protein, 1036 aa, Artificial Sequence
  Description of Artificial Sequence: Synthetic coding sequence
MNITHAYSQGHQKLNLDTVSYNMLGVDSDGCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 10857 - protein, 1024 aa, Artificial Sequence
  Description of Artificial Sequence: Synthetic coding sequence
MELPFVTHLFLPLVFLTGCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 10858 - protein, 1095 aa, Artificial Sequence
  Description of Artificial Sequence: Synthetic coding sequence
MNITHAYSQGHQKLNLDTVSYNMLGVDSDGCWWAPPGMGLQATGGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 10859 - protein, 1063 aa, Artificial Sequence
  Description of Artificial Sequence: Synthetic coding sequence
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQAHILVDCGEDNLCVPDLKLSARPDKHQVIIGDENHLMLIINARNEGEGAYEAELFVMIPEEADYVGIERNNKGFRPLSCEYKMENVTRMVVCDLGNPMVSGTNYSLGLRFAVPRLEKTNMSINFDLQIRSSNKDNPDSNFVSLQINITAVAQVEIRGVSHPPQIVLPIHNWEPEEEPHKEEEVGPLVEHIYELHNIGPSTISDTILEVGWPFSARDEFLLYIFHIQTLGPLQCQPNPNINPQDIKPAASPEDTPELSAFLRNSTIPHLVRKRDVHVVEFHRQSPAKILNCTNIECLQISCAVGRLEGGESAVLKVRSRLWAHTFLQRKNDPYALASLVSFEVKKMPYTDQPAKLPEGSIVIKTSVIWATPNVSFSIPLWVIILAILLGLLVLAILTLALWKCGFFDRARPPQEDMTDREQLTNDKTPEA

SEQ ID NO: 10860 - protein, 1048 aa, Artificial Sequence
  Description of Artificial Sequence: Synthetic coding sequence
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQAHILVDCGEDNLCVPDLKLSARPDKHQVIIGDENHLMLIINARNEGEGAYEAELFVMIPEEADYVGIERNNKGFRPLSCEYKMENVTRMVVCDLGNPMVSGTNYSLGLRFAVPRLEKTNMSINFDLQIRSSNKDNPDSNFVSLQINITAVAQVEIRGVSHPPQIVLPIHNWEPEEEPHKEEEVGPLVEHIYELHNIGPSTISDTILEVGWPFSARDEFLLYIFHIQTLGPLQCQPNPNINPQDIKPAASPEDTPELSAFLRNSTIPHLVRKRDVHVVEFHRQSPAKILNCTNIECLQISCAVGRLEGGESAVLKVRSRLWAHTFLQRKNDPYALASLVSFEVKKMPYTDQPAKLPEGSIVIKTSVIWATPNVSFSIPLWVIILAILLGLLVLAILTLALWKCGFFDRARPPQEDMTDREQLTNDKTPEA

SEQ ID NO: 10861 - protein, 1179 aa, Artificial Sequence
  Description of Artificial Sequence: Synthetic coding sequence
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVVAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 10862 - protein, 799 aa, Artificial Sequence
  Description of Artificial Sequence: Synthetic coding sequence
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 10863 - protein, 769 aa, Artificial Sequence
  Description of Artificial Sequence: Synthetic coding sequence
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 10864 - protein, 634 aa, Artificial Sequence
  Description of Artificial Sequence: Synthetic coding sequence
MLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 10865 - protein, 437 aa, Artificial Sequence
  Description of Artificial Sequence: Synthetic coding sequence
MTSYMAIDGSALVPLRQKPRRKTQGFLTMSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 10866 - protein, 438 aa, Artificial Sequence
  Description of Artificial Sequence: Synthetic coding sequence
MTSYMAIDGSALQVPLRQKPRRKTQGFLTMSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 10867 - protein, 438 aa, Artificial Sequence; identical to SEQ ID NO: 10866
  Description of Artificial Sequence: Synthetic coding sequence

SEQ ID NO: 10868 - protein, 78 aa, Artificial Sequence
  Description of Artificial Sequence: Synthetic coding sequence
MTSYMAIDGSALVPLRQKPRRKTQGFLTMSRRRISCKDLGHADCQGWLYKKKEKGSFLSNKWKKFWVILKGSSLYWYS

SEQ ID NO: 10869 - protein, 131 aa, Artificial Sequence
  Description of Artificial Sequence: Synthetic coding sequence
MFSDNSHCPDCGQQWFPSLELGHWLYQTELVENECYQVFLDRINRADYCPECYPDNPANRSLVLPWSFPLEWAPQNLTRWTFEKACHPFLLGPPLVRKRIHDSRVAGFNPALQLILTRTDKTLNKKLGQNK

SEQ ID NO: 10870 - protein, 228 aa, Artificial Sequence
  Description of Artificial Sequence: Synthetic coding sequence
MREGKRGPPCILSFRGTLERVEAQWELEAQGPGQCPAPLGDPASTTDGAQEARVPLDGAFWIPRPPAGSPKGCFACVSKPPALQAPAAPAPEPSASPPMAPTLFPMESKSSKTDSVRAAGAPPACKHLAEKKTMTNPTTVIEVYPDTTEVNDYYLWSIFNFVYLNFCCLGFIALAYSLKVRDKKLLNDLNGAVEDAKTARLFNITSSALAASCIILVFIFLRYPLTDY

SEQ ID NO: 10871 - protein, 132 aa, Artificial Sequence
  Description of Artificial Sequence: Synthetic coding sequence
MDTAYPREDTRAPTPSKAGAHTALTLGAPHPPPRDHLIWSVFSTLYLNLCCLGFLALAYSIKARDQKVVGDLEAARRFGSKAKCYNILAAMWTLVPPLLLLGLVVTGALHLARLAKDSAAFFSTKFDDADYD

SEQ ID NO: 10872 - protein, 516 aa, Artificial Sequence
  Description of Artificial Sequence: Synthetic coding sequence
MPVPERPAAGPDSPRPGTRRAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 10873 - protein, 474 aa, Artificial Sequence
  Description of Artificial Sequence: Synthetic coding sequence
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 10874 - protein, 210 aa, Artificial Sequence
  Description of Artificial Sequence: Synthetic coding sequence
MYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 10875 - protein, 516 aa, Artificial Sequence; identical to SEQ ID NO: 10872
  Description of Artificial Sequence: Synthetic coding sequence

SEQ ID NO: 10876 - protein, 474 aa, Artificial Sequence; identical to SEQ ID NO: 10873
  Description of Artificial Sequence: Synthetic coding sequence

SEQ ID NO: 10877 - protein, 503 aa, Artificial Sequence
  Description of Artificial Sequence: Synthetic coding sequence
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 10878 - protein, 104 aa, Artificial Sequence
  Description of Artificial Sequence: Synthetic coding sequence
MGKESGWDSGRAAVAAVVGGVVAVGTVLVALSAMGFTSVGIAASSIAAKMMSTAAIANGGGVAAGSLVAILQSVGAAGLSVTSKVIGGFAGTALGAWLGSPPSS

SEQ ID NO: 10879 - protein, 104 aa, Artificial Sequence; identical to SEQ ID NO: 10878
  Description of Artificial Sequence: Synthetic coding sequence

SEQ ID NO: 10880 - protein, 130 aa, Artificial Sequence
  Description of Artificial Sequence: Synthetic coding sequence
MMKRAAAAAVGGALAVGAVPVVLSAMGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 10881 - protein, 138 aa, Artificial Sequence
  Description of Artificial Sequence: Synthetic coding sequence
MRQKAVSLFLCYLLLFTCSGVEAGENAGKDAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 10882 - protein, 130 aa, Artificial Sequence
  Description of Artificial Sequence: Synthetic coding sequence
MRQKAVSLFLCYLLLFTCSGVEAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 10883 - protein, 134 aa, Artificial Sequence
  Description of Artificial Sequence: Synthetic coding sequence
MRQKAVSLFLCYLLLFTCSGVEAGENAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 10884 - protein, 325 aa, Artificial Sequence
  Description of Artificial Sequence: Synthetic coding sequence
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 10885 - protein, 322 aa, Artificial Sequence
  Description of Artificial Sequence: Synthetic coding sequence
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSPTSRTPRPWT

SEQ ID NO: 10886 - protein, 147 aa, Artificial Sequence
  Description of Artificial Sequence: Synthetic coding sequence
MKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEERPFPWYWPCLPLLASC

SEQ ID NO: 10887 - protein, 311 aa, Artificial Sequence
  Description of Artificial Sequence: Synthetic coding sequence
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 10888 - protein, 574 aa, Artificial Sequence
  Description of Artificial Sequence: Synthetic coding sequence
MRTLLTILTVGSLAAHAPEDPSDLLQHVKFQSSNFENILTWDSGPEGTPDTVYSIEYKTYGERDWVAKKGCQRITRKSCNLTVETGNLTELYYARVTAVSAGGRSATKMTDRFSSLQHTTLKPPDVTCISKVRSIQMIVHPTPTPIRAGDGHRLTLEDIFHDLFYHLELQVNRTYQMHLGGKQREYEFFGLTPDTEFLGTIMICVPTWAKESAPYMCRVKTLPDRTWTYSFSGAFLFSMGFLVAVLCYLSYRYVTKPPAPPNSLNVQRVLTFQPLRFIQEHVLIPVFDLSGPSSLAQPVQYSQIRVSGPREPAGAPQRHSLSEITYLGQPDISILQPSNVPPPQILSPLSYAPNAAPEVGPPSYAPQVTPEAQFPFYAPQAISKVQPSSYAPQATPDSWPPSYGVCMEGSGKDSPTGTLSSPKHLRPKGQLQKEPPAGSCMLGGLSLQEVTSLAMEESQEAKSLHQPLGICTDRTSDPNVLHSGEEGTPQYLKGQLPLLSSVQIEGHPMSLPLQPPSRPCSPSDQGPSPWGLLESLVCPKDEAKSPAPETSDLEQPTELDSLFRGLALTVQWES

SEQ ID NO: 10889 - protein, 636 aa, Artificial Sequence
  Description of Artificial Sequence: Synthetic coding sequence
MRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWKVLPGILFLWGLFLLGCGLSLATSGRCYHLRHKVLPRWVWEKVPDPANSSSGQPHMEQVPEAQPLGDLPILEVEEMEPPPVMESSQPAQATAPLDSGYEKHFLPTPEELGLLGPPRPQVLA

SEQ ID NO: 10890 - protein, 150 aa, Artificial Sequence
  Description of Artificial Sequence: Synthetic coding sequence
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIGKKLYIKVWLSLLGYLKTLCLDIL

SEQ ID NO: 10891 - protein, 180 aa, Artificial Sequence
  Description of Artificial Sequence: Synthetic coding sequence
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTD

SEQ ID NO: 10892 - protein, 630 aa, Artificial Sequence
  Description of Artificial Sequence: Synthetic coding sequence
MPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 10893 - protein, 695 aa, Artificial Sequence
  Description of Artificial Sequence: Synthetic coding sequence
MFLGTGEPALDTGDDSLSAVTFDSDVETKAKRKAFHKPPPTSPKSPYLSKPRKVASWRSLRTAGSMPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 10894 - protein, 644 aa, Artificial Sequence
  Description of Artificial Sequence: Synthetic coding sequence
MFLGTGEPALDTSHLISLSRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 10895 - protein, 128 aa, Artificial Sequence
  Description of Artificial Sequence: Synthetic coding sequence
MPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSR

SEQ ID NO: 10896 - protein, 128 aa, Artificial Sequence; identical to SEQ ID NO: 10895
  Description of Artificial Sequence: Synthetic coding sequence

SEQ ID NO: 10897 - protein, 679 aa, Artificial Sequence
  Description of Artificial Sequence: Synthetic coding sequence
MFLGTGEPALDTKAKRKAFHKPPPTSPKSPYLSKPRKVASWRSLRTAGSMPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 10898 - protein, 1631 aa, Artificial Sequence
  Description of Artificial Sequence: Synthetic coding sequence
MERRAAGPGWAAYERLTAEEMDEQRRQNVAYQYLCRLEEAKRWMEACLKEELPSPVELEESLRNGVLLAKLGHCFAPSVVPLKKIYDVEQLRYQATGLHFRHTDNINFWLSAIAHIGLPSTFFPETTDIYDKKNMPRVVYCIHALSLFLFRLGLAPQIHDLYGKVKFTAEELSNMASELAKYGLQLPAFSKIGGILANELSVDEAAVHAAVLAINEAVERGVVEDTLAALQNPSALLENLREPLAAVYQEMLAQAKMEKAANARNHDDRESQDIYDHYLTQAEIQGNINHVNVHGALEVVDDALERQSPEALLKALQDPALALRGVRRDFADWYLEQLNSDREQKAQELGLVELLEKEEVQAGVAAANTKGDQEQAMLHAVQRINKAIRRRVAADTVKELMCPEAQLPPVYPVASSMYQLELAVLQQQQGELGQEELFVAVEMLSAVVLINRALEARDASGFWSSLVNPATGLAEVEGENAQRYFDALLKLRQERGMGEDFLSWNDLQATVSQVNAQTQEETDRVLAVSLINEALDKGSPEKTLSALLLPAAGLDDVSLPVAPRYHLLLVAAKRQKAQVTGDPGAVLWLEEIRQGVVRANQDTNTAQRMALGVAAINQAIKEGKAAQTERVLRNPAVALRGVVPDCANGYQRALESAMAKKQRPADTAFWVQHDMKDGTAYYFHLQTFQGIWEQPPGCPLNTSHLTREEIQSAVTKVTAAYDRQQLWKANVGFVIQLQARLRGFLVRQKFAEHSHFLRTWLPAVIKIQAHWRGYRQRKIYLEWLQYFKANLDAIIKIQAWARMWAARRQYLRRLHYFQKNVNSIVKIQAFFRARKAQDDYRILVHAPHPPLSVVRRFAHLLNQSQQDFLAEAELLKLQEEVVRKIRSNQQLEQDLNIMDIKIGLLVKNRITLQEVVSHCKKLTKRNKEQLSDMMVLDKQKGLKSLSKEKRQKLEAYQHLFYLLQTQPIYLAKLIFQMPQNKTTKFMEAVIFSLYNYASSRREAYLLLQLFKTALQEEIKSKVEQPQDVVTGNPTVVRLVVRFYRNGRGQSALQEILGKVIQDVLEDKVLSVHTDPVHLYKNWINQTEAQTGQRSHLPYDVTPEQALSHPEVQRRLDIALRNLLAMTDKFLLAITSSVDQIPYGMRYVAKVLKATLAEKFPDATDSEVYKVVGNLLYYRFLNPAVVAPDAFDIVAMAAGGALAAPQRHALGAVAQLLQHAAAGKAFSGQSQHLRVLNDYLEETHLKFRKFIHRACQVPEPEERFAVDEYSDMVAVAKPMVYITVGELVNTHRLLLEHQDCIAPDHQDPLHELLEDLGELPTIPDLIGESIAADGHTDLSKLEVSLTLTNKFEGLEADADDSNTRSLLLSTKQLLADIIQFHPGDTLKEILSLSASREQEAAHKQLMSRRQACTAQTPEPLRRHRSLTAHSLLPLAEKQRRVLRNLRRLEALGLVSARNGYQGLVDELAKDIRNQHRHRHRRKAELVKLQATLQGLSTKTTFYEEQGDYYSQYIRACLDHLAPDSKSSGKGKKQPSLHYTAAQLLEKGVLVEIEDLPASHFRNVIFDITPGDEAGKFEVNAKFLGVDMERFQLHYQDLLQLQYEGVAVMKLFNKAKVNVNLLIFLLNKKFLRK

SEQ ID NO: 10899 - protein, 154 aa, Artificial Sequence
  Description of Artificial Sequence: Synthetic coding sequence
MAAAWGSSLTAATQRAVTPWPRGRLLTASLGPQARREASSSSPEAGEGQIRLTDSCVQRLLEITEGSEFLRLQVEGGGCSGFQYKFSLDTVINPDDRVFEQGGARVVVDSDSLAFVKGAQVDFSQELIRSSFQVLNNPQAQQGCSCGSSFSIKL

SEQ ID NO: 10900 - protein, 221 aa, Artificial Sequence
  Description of Artificial Sequence: Synthetic coding sequence
MPLALTLLLLSGLGAPGGWGCLQCDPLVLEALGHLRSALIPSRFQLEQLQARAGAVLMGMEGPFFRDYALNVFVGKVETNQLDLVASFVKNQTQHLMGNSLKDEPLLEELVTLRANVIKEFKKVLISYELKACNPKLCRLLKEEVLDCLHCQRITPKCIHKKYCFVDRQPRVALQYQMDSKYPRNQALLGILISVSLAVFVFVVIVVSACTYRQNRKLLLQ

SEQ ID NO: 10901 - protein, 192 aa, Artificial Sequence
  Description of Artificial Sequence: Synthetic coding sequence
MPLALTLLLLSGLGAPGGWGCLQCDPLVLEALGHLRSALIPSRFQLEQLQARAGAVLMGMEGPFFRDYALNVFVGKVETNQLDLVASFVKNQTQHLMGNSLKDEPLLEELVTLRANVIKEFKKVLISYELKAGNPAWPCSTRWTANTRGTRRCWASSFLCLWLSLSSWSSWSRLVHTDKTENSCCSRTVVWG

SEQ ID NO: 10902 - protein, 239 aa, Artificial Sequence
  Description of Artificial Sequence: Synthetic coding sequence
MGDLWLFLLLPLSAFHGVKGCLECDPKFIEDVGSLLGNLIPSEVPGRTQLLERQIKEMIHLSFKVSHSDKRLRVLAVQQVVKLRTWLKNEFYKLGNETWKGVFIYQGKLLDVCQNLESKLKELLKNFSEIACSEDCIVVEGPILDCWTCLRMTNRCFKGEYCGDEDPRKAENREIALFLILLATAVILGSAVLLFHFCIFHRRKMKAIRRSLKEYVEKKLEELMGKIDEKEEKDFRLRK

SEQ ID NO: 10903 - protein, 350 aa, Artificial Sequence
  Description of Artificial Sequence: Synthetic coding sequence
MGPHFTLLCAALAGCLLPAEGCVICDPSVVLALKSLEKDYLPGHLDAKHHKAMMERVENAVKDFQELSLNEDAYMGVVDEATLQKGSWSLLKDLKRITDSDVKGDLFVKELFWMLHLQKETFATYVARFQKEAYCPNKCGVMLQTLIWCKNCKKEVHACRKSYDCGERNVEVPQMEDMILDCELNWHQASEGLTDYSFYRVWGNNTETLVSKGKEATLTKPMVGPEDAGSYRCELGSVNSSPATIINFHVTVLPKMIKEEKPSPNIVTPGEATTESSISLQPLQPEKMLASRLLGLLICGSLALITGLTFAIFRRRKVIDFIKSSLFGLGSGAAEQTQVPKEKATDSRQQ

SEQ ID NO: 10904 - protein, 183 aa, Artificial Sequence
  Description of Artificial Sequence: Synthetic coding sequence
MASRAGPRAAGTDGSDFQHRERVAMHYQMSVTLKYEIKKLIYVHLVIWLLLVAKMSVGHLRLLSHDQVAMPYQWEYPYLLSILPSLLGLLSFPRNNISYLVLSMISMGLFSIAPLIYGSMEMFPAAQQLYRHGKAYRFLFGFSAVSIMYLVLVLAVQVHAWQLYYSKKLLDSWFTSTQEKKHK

SEQ ID NO: 10905 - protein, 181 aa, Artificial Sequence
  Description of Artificial Sequence: Synthetic coding sequence
MASRAGPRAAGTDGSDFQHRERVAMHYQMSVTLKYEIKKLIYVHLVIWLLLVAKMSVGHLRLLSHDQVAMPYQWEYPYLLSILPSLLGLLSFPRNNISYLVLSMISMGLFHRSTHLWQHGDVPCCTAATAMARPTVSSLVFLPFPMYLVLVLAVQVHAWQLYYSKKLLDSWFTSTQEKKHK

SEQ ID NO: 10906 - protein, 626 aa, Artificial Sequence
  Description of Artificial Sequence: Synthetic coding sequence
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEVRDSICCKLSNGADILFEPKLKFM

SEQ ID NO: 10907 - protein, 831 aa, Artificial Sequence
  Description of Artificial Sequence: Synthetic coding sequence
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEERERRSPAFNLQITTFPENHSSALQLFCHQEGVKDVNVSELMKKLDILGDNGNLRNEEQVAIIQAGTVLALCEKWLKQIEGTEAALTQKMLDLEKEKDLFSRQKGYLEEELDYRKQALDQAYLKIQDLEATLYTALQQEPGRRAGEALSEGQREDLQAAVEKVRRQILRQSREFDSQILRERMELLQQAQQRIRELEDKLEFQKRHLKELEEKFLFLFLFFSLAFILWP

SEQ ID NO: 10908 - protein, 646 aa, Artificial Sequence
  Description of Artificial Sequence: Synthetic coding sequence
MSKKGRSKGEKPEMETDAVQMANEELRAKLTSIQIEFQQEKSKMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEERERRSPAFNLQITTFPENHSSALQLFCHQEGVKDVNVSELMKKLDILGDNGNLRNEEQVAIIQAGTVLALCEKWLKQIEGTEAALTQKMLDLEKEKDLFSRQKGYLEEELDYRKQALDQAYLKIQDLEATLYTALQQEPGRRAGEALSEGQREDLQAAVEKVRRQILRQSREFDSQILRERMELLQQAQQRIRELEDKLEFQKRHLKELEEKFLFLFLFFSLAFILWP

SEQ ID NO: 10909 - protein, 626 aa, Artificial Sequence; identical to SEQ ID NO: 10906
  Description of Artificial Sequence: Synthetic coding sequence

SEQ ID NO: 10910 - protein, 431 aa, Artificial Sequence
  Description of Artificial Sequence: Synthetic coding sequence
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMPDPAGAHGAAAAGPAENPRTGGQTGVSEAAPERTGGKVFVPFFVFLTSIHSVALMTSVSQELGL

SEQ ID NO: 10911 - protein, 569 aa, Artificial Sequence
  Description of Artificial Sequence: Synthetic coding sequence
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREDLQAAVEKVRRQILRQSREFDSQILRERMELLQQAQQRIRELEDKLEFQKRHLKELEEKFLFLFLFFSLAFILWP

SEQ ID NO: 10912 - protein, 518 aa, Artificial Sequence
  Description of Artificial Sequence: Synthetic coding sequence
MSKKGRSKGEKPEMETDAVQMANEALREGLIRQHEQEAARTAKIKEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEVRDSICCKLSNGADILFEPKLKFM

SEQ ID NO: 10913 - protein, 810 aa, Artificial Sequence
  Description of Artificial Sequence: Synthetic coding sequence
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQDSHWVEDKQLFIKRNQELLEKIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKSNRKHG

SEQ ID NO: 10914 - protein, 778 aa, Artificial Sequence
  Description of Artificial Sequence: Synthetic coding sequence
MVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQDSHWVEDKQLFIKRNQELLEKIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKFLFLFLFFSLAFILWP

SEQ ID NO: 10915 - protein, 799 aa, Artificial Sequence
  Description of Artificial Sequence: Synthetic coding sequence
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKFLFLFLFFSLAFILWP

SEQ ID NO: 10916 - protein, 789 aa, Artificial Sequence
  Description of Artificial Sequence: Synthetic coding sequence
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKSNRMPA

SEQ ID NO: 10917 - protein, 844 aa, Artificial Sequence
  Description of Artificial Sequence: Synthetic coding sequence
MSKRGMSSRAKGDKAEALAALQAANEDLRAKLTDIQIELQQEKSKVSKVEREKNQELRQVREHEQHKTAVLLTELKTKLHEEKMKELQAVRETLLRQHEAELLRVIKIKDNENQRLQALLSALRDGGPEKVKTVLLSEAKEEAKKGFEVEKVKMQQEISELKGAKRQVEEALTLVIQADKIKAAEIRSVYHLHQEEITRIKKECEREIRRLMEEIKFKDRAVFVLERELGVQAGHAQRLQLQKEALDEQLSQVREADRHPGSPRRELPHAAGAGDASDHSGSPEQQLDEKDARRFQLKIAELSAIIRKLEDRNALLSEERNELLKRVREAESQYKPLLDKNKRLSRKNEDLSHALRRMENKLKFVTQENIEMRQRAGIIRRPSSLNDLDQSQDEREVDFLKLQIVEQQNLIDELSKTLETAGYVKSVLERDKLLRFRKQRKKMAKLPKPVVVETFFGYDEEASLESDGSSVSYQTDRTDQTPCTPDDDLEEGMAKEETELRFRQLTMEYQALQRAYALLQEQVGGTLDAEREVKTREQLQAEVQRAQARIEDLEKALAEQGQDMKWIEEKQALYRRNQELVEKIKQMETEEARLRHEVQDARDQNELLEFRILELEERERKSPAISFHHTPFVDGKSPLQVYCEAEGVTDIVVAELMKKLDILGDNANLTNEEQVVVIQARTVLTLAEKWLQQIEETEAALQRKMVDLESEKELFSKQKGYLDEELDYRKQALDQANKHILELEAMLYDALQQEAGAKVAELLSEEEREKLKVAVEQWKRQVMSELRERDAQILRERMELLQLAQQRIKELEERIEAQKRQIKELEEKFLFLFLFFSLAFILWS

SEQ ID NO: 10918 - protein, 331 aa, Artificial Sequence
  Description of Artificial Sequence: Synthetic coding sequence
MSMTTRAWEELDGGLGSCQALEDHSALAETQEDRASATPRLADSGSVPHDSQVAEGPSVDTRPKKMEKEPAARGTPGTGKERLKAGASPRSVPARKKAQTAPPLQPPPPPPALSEELPWGDLSLNKCLVLASLVALLGSAFQLCRDAVPGEAALQARVPEPWVPPSSAPREPSSPLPKFEAQAPPSAPPAPRAEAEVRPKIPGSREAAENDEEEPGEATGEAVREDRVTLADRGPKERPRREGKPRKEKPRKEERPKKERPRKEERPRAAREPREALPQRWESREGGHRPWARDSRDAEPRKKQAWVSPRRPDEEQRPGSRQKLRAGKGRD

SEQ ID NO: 10919 - protein, 628 aa, Artificial Sequence
  Description of Artificial Sequence: Synthetic coding sequence
MSPGGKFDFDDGGCYVGGWEAGRAHGYGVCTGPGAQGEYSGCWAHGFESLGVFTGPGGHSYQGHWQQGKREGLGVERKSRWTYRGEWLGGLKGRSGVWESVSGLRYAGLWKDGFQDGYGTETYSDGGTYQGQWQAGKRHGYGVRQSVPYHQAALLRSPRRTSLDSGHSDPPTPPPPLPLPGDEGGSPASGSRGGFVLAGPGDADGASSRKRTPAAGGFFRRSLLLSGLRAGGRRSSLGSKRGSLRSEVSSEVGSTGPPGSEASGPPAAAPPALIEGSATEVYAGEWRADRRSGFGVSQRSNGLRYEGEWLGNRRHGYGRTTRPDGSREEGKYKRNRLVHGGRVRSLLPLALRRGKVKEKVDRAVEGARRAVSAARQRQEIAAARAADALLKAVAASSVAEKAVEAARMAKLIAQDLQPMLEAPGRRPRQDSEGSDTEPLDEDSPGVYENGLTPSEGSPELPSSPASSRQPWRPPACRSPLPPGGDQGPFSSPKAWPEEWGGAGAQAEELAGYEAEDEAGMQGPGPRDGSPLLGGCSDSSGSLREEEGEDEEPLPPLRAPAGTEPEPIAMLVLRGSSSRGPDAGCLTEELGEPAATERPAQPGAANPLVVGAVALLDLSLAFLFSQLLT

SEQ ID NO: 10920 - protein, 628 aa, Artificial Sequence; identical to SEQ ID NO: 10919
  Description of Artificial Sequence: Synthetic coding sequence

SEQ ID NO: 10921 - protein, 628 aa, Artificial Sequence; identical to SEQ ID NO: 10919
  Description of Artificial Sequence: Synthetic coding sequence

SEQ ID NO: 10922 - protein, 507 aa, Artificial Sequence
  Description of Artificial Sequence: Synthetic coding sequence
MRRLPRALLLQLRLALLVAAGAPEVLVSAPRSLVWGPGLQAAVVLPVRYFYLQAVNSEGQNLTRSPAGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 10923 - protein, 409 aa, Artificial Sequence
  Description of Artificial Sequence: Synthetic coding sequence
MVELFIFLFLLGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKSFTLSPRLECSGTISTHCNLCLPGSRNFVPQPPE

SEQ ID NO: 10924 - protein, 451 aa, Artificial Sequence
  Description of Artificial Sequence: Synthetic coding sequence
MVELFIFLFLLGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 10925 - protein, 212 aa, Artificial Sequence
  Description of Artificial Sequence: Synthetic coding sequence
MNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 10926 - protein, 212 aa, Artificial Sequence
  Description of Artificial Sequence: Synthetic coding sequence
MNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 10927 - protein, 186 aa, Artificial Sequence
  Description of Artificial Sequence: Synthetic coding sequence
MNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEYSRERSSVCQHKCQRPSPASVLQGARTEFLPQQRHKMLDTENQKLNSFVADSHQWLCKNAEEKSQKVSV

SEQ ID NO: 10928 - protein, 214 aa, Artificial Sequence
  Description of Artificial Sequence: Synthetic coding sequence
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKVLKGKKLSLPMPI

SEQ ID NO: 10929 - protein, 220 aa, Artificial Sequence
  Description of Artificial Sequence: Synthetic coding sequence
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKGRSWDDSNADTGLRSYSSI

SEQ ID NO: 10930 - protein, 777 aa, Artificial Sequence
  Description of Artificial Sequence: Synthetic coding sequence
MFPRGAEAQDWHLDMQLTGKVVLSAAALLLVTVAYRLYKSRPAPAQRWGGNGQAEAKEEAEGSGQPAVQEASPGVLLRGPRRRRSSKRAEAPQGCSCENPRGPYVLVTGATSTDRKPQRKGSGEERGGQGSDSEQVPPCCPSQETRTAVGSNPDPPHFPRLGSEPKSSPAGLIAAADGSCAGGEPSPWQDSKPREHPGLGQLEPPHCHYVAPLQGSSDMNQSWVFTRVIGVSREEAGALEAASDVDLTLHQQEGAPNSSYTFSSIARVRMEEHFIQKAEGVEPRLKGKVYDYYVESTSQAIFQGRLAPRTAALTEVPSPRPPPGSLGTGAASGGQAGDTKGAAERAASPQTGPWPSTRGFSRKESLLQIAENPELQLQPDGFRLPAPPCPDPGALPGLGRSSREPHVQPVAGTNFFHIPLTPASAPQVRLDLGNCYEVLTLAKRQNLEALKEAAYKVMSENYLQVLRSPDIYGCLSGAERELILQRRLRGRQYLVVADVCPKEDSGGLCCYDDEQDVWRPLARMPPEAVSRGCAICSLFNYLFVVSGCQGPGHQPSSRVFCYNPLTGIWSEVCPLNQARPHCRLVALDGHLYAIGGECLNSVERYDPRLDRWDFAPPLPSDTFALAHTATVRAKEIFVTGGSLRFLLFRFSAQEQRWWAGPTGGSKDRTAEMVAVNGFLYRFDLNRSLGIAVYRCSASTRLWYECATYRTPYPDAFQCAVVDNLIYCVGRRSTLCFLADSVSPRFVPKELRSFPAPQGTLLPTVLTLPTPDLPQTRV

SEQ ID NO: 10931 - protein, 695 aa, Artificial Sequence
  Description of Artificial Sequence: Synthetic coding sequence
GQPAVQEASPGVLLRGPRRRRSSKRAEAPQGCSCENPRGPYVLVTGATSTDRKPQRKGSGEERGGQGSDSEQVPPCCPSQETRTAVGSNPDPPHFPRLGSEPKSSPAGLIAAADGSCAGGEPSPWQDSKPREHPGLGQLEPPHCHYVAPLQGSSDMNQSWVFTRVIGVSREEAGALEAASDVDLTLHQQEGAPNSSYTFSSIARVRMEEHFIQKAEGVEPRLKGKVYDYYVESTSQAIFQGRLAPRTAALTEVPSPRPPPGSLGTGAASGGQAGDTKGAAERAASPQTGPWPSTRGFSRKESLLQIAENPELQLQPDGFRLPAPPCPDPGALPGLGRSSREPHVQPVAGTNFFHIPLTPASAPQVRLDLGNCYEVLTLAKRQNLEALKEAAYKVMSENYLQVLRSPDIYGCLSGAERELILQRRLRGRQYLVVADVCPKEDSGGLCCYDDEQDVWRPLARMPPEAVSRGCAICSLFNYLFVVSGCQGPGHQPSSRVFCYNPLTGIWSEVCPLNQARPHCRLVALDGHLYAIGGECLNSVERYDPRLDRWDFAPPLPSDTFALAHTATVRAKEIFVTGGSLRFLLFRFSAQEQRWWAGPTGGSKDRTAEMVAVNGFLYRFDLNRSLGIAVYRCSASTRLWYECATYRTPYPDAFQCAVVDNLIYCVGRRSTLCFLADSVSPREAAIVPSYLLVEVC

SEQ ID NO: 10932 - protein, 642 aa, Artificial Sequence
  Description of Artificial Sequence: Synthetic coding sequence
MQPRSERPAGRTQSPEHGSPGPGPEAPPPPPPQPPAPEAERTRPRQARPAAPMEGAVQLLSREGHSVAHNSKRHYHDAFVAMSRMRQRGLLCDIVLHVAAKEIRAHKVVLASCSPYFHAMFTNEMSESRQTHVTLHDIDPQALDQLVQFAYTAEIVVGEGNVQTLLPAASLLQLNGVRDACCKFLLSQLDPSNCLGIRGFADAHSCSDLLKAAHRYVLQHFVDVAKTEEFMLLPLKQVLELVSSDSLNVPSEEEVYRAVLSWVKHDVDARRQHVPRLMKCVRLPLLSRDFLLGHVDAESLVRHHPDCKDLLIEALKFHLLPEQRGVLGTSRTRPRRCEGAGPVLFAVGGGSLFAIHGDCEAYDTRTDRWHVVASMSTRRARVGVAAVGNRLYAVGGYDGTSDLATVESYDPVTNTWQPEVSMGTRRSCLGVAALHGLLYSAGGYDGASCLNSAERYDPLTGTWTSVAAMSTRRRYVRVATLDGNLYAVGGYDSSSHLATVEKYEPQVNVWSPVASMLSRRSSAGVAVLEGALYVAGGNDGTSCLNSVERYSPKAGAWESVAPMNIRRSTHDLVAMDGWLYAVGGNDGSSSLNSIEKYNPRTNKWVAASCMFTRRSSVGVAVLELLNFPPPSSPTLSVSSTSL

SEQ ID NO: 10933 - protein, 518 aa, Artificial Sequence
  Description of Artificial Sequence: Synthetic coding sequence
MSESRQTHVTLHDIDPQALDQLVQFAYTAEIVVGEGNVQTLLPAASLLQLNGVRDACCKFLLSQLDPSNCLGIRGFADAHSCSDLLKAAHRYVLQHFVDVAKTEEFMLLPLKQVLELVSSDSLNVPSEEEVYRAVLSWVKHDVDARRQHVPRLMKCVRLPLLSRDFLLGHVDAESLVRHHPDCKDLLIEALKFHLLPEQRGVLGTSRTRPRRCEGAGPVLFAVGGGSLFAIHGDCEAYDTRTDRWHVVASMSTRRARVGVAAVGNRLYAVGGYDGTSDLATVESYDPVTNTWQPEVSMGTRRSCLGVAALHGLLYSAGGYDGASCLNSAERYDPLTGTWTSVAAMSTRRRYVRVATLDGNLYAVGGYDSSSHLATVEKYEPQVNVWSPVASMLSRRSSAGVAVLEGALYVAGGNDGTSCLNSVERYSPKAGAWESVAPMNIRRSTHDLVAMDGWLYAVGGNDGSSSLNSIEKYNPRTNKWVAASCMFTRRSSVGVAVLELLNFPPPSSPTLSVSSTSL

SEQ ID NO: 10934 - protein, 225 aa, Artificial Sequence
  Description of Artificial Sequence: Synthetic coding sequence
MKCVRLPLLSRDFLLGHVDAESLVRHHPDCKDLLIEALKFHLLPEQRGVLGTSRTRPRRCEGAGPVLFAVGGGSLFAIHGDCEAYDTRTDRWHVVASMSTRRARVGVAAVGNRLYAVGGYDGTSDLATVESYDPVTNTWQPEVSMGTRRSCLGVAALHGLLYSAGGYDGASCLNSAERYDPLTGTWTSVAAMSTRRRYVRVATLDGNLYAVGGYDSSSHLATVEK

SEQ ID NO: 10935 - protein, 162 aa, Artificial Sequence
  Description of Artificial Sequence: Synthetic coding sequence
MRIANRTRFSSPFLARGAGWTHGRGMMVVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 10936 - protein, 240 aa, Artificial Sequence
  Description of Artificial Sequence: Synthetic coding sequence
MRRCSLCAFDAARGPRRLMRVGLALILVGHVNLLLGAVLHGTVLRHVANPRGAVTPEYTVANVISVGSGLLSVSVGLVALLASRNLLRPPLHWVLLALALVNLLLSVACSLGLLLAVSLTVANGGRRLIADCHPGLLDPLVPLDEGPGHTDCPFDPTRIYDTALALWIPSLLMSAGEAALSGYCCVAALTLRGVGPCRKDGLQGQLEEMTELESPKCKRQENEQLLDQNQEIRASQRSWV

SEQ ID NO: 10937 - protein, 222 aa, Artificial Sequence
  Description of Artificial Sequence: Synthetic coding sequence
MRVGLALILVGHVNLLLGAVLHGTVLRHVANPRGAVTPEYTVANVISVGSGLLSVSVGLVALLASRNLLRPPLHWVLLALALVNLLLSVACSLGLLLAVSLTVANGGRRLIADCHPGLLDPLVPLDEGPGHTDCPFDPTRIYDTALALWIPSLLMSAGEAALSGYCCVAALTLRGVGPCRKDGLQGQLEEMTELESPKCKRQENEQLLDQNQEIRASQRSWV

SEQ ID NO: 10938 - protein, 62 aa, Artificial Sequence
  Description of Artificial Sequence: Synthetic coding sequence
ALSGYCCVAALTLRGVGPCRKDGLQGQLEEMTELESPKCKRQENEQLLDQNQEIRASQRSWV

SEQ ID NO: 10939 - protein, 240 aa, Artificial Sequence; identical to SEQ ID NO: 10936
  Description of Artificial Sequence: Synthetic coding sequence

SEQ ID NO: 10940 - protein, 993 aa, Artificial Sequence
  Description of Artificial Sequence: Synthetic coding sequence
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 10941 - protein, 1356 aa, Artificial Sequence
  Description of Artificial Sequence: Synthetic coding sequence
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMQEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 10942 - protein, 303 aa, Artificial Sequence
  Description of Artificial Sequence: Synthetic coding sequence
MCHGRIAPKSTSVFAVASVGHGVFLPLVILCTLLGDGLASVCPLPPEPENGGYICHPRPCRDPLTAGSVIEYLCAEGYMLKGDYKYLTCKNGEWKPAMEISCRLNEDKDTHTSLGVPTLSIVASTASSVALILLLVVLFVLLQPKLKSFHHSRRDQGVSGDQVSIMVDGVQVALPSYEEAVYGSSGHCVPPADPRVQIVLSEGSGPSGRSVPREQQLPDQGACSSAGGEDEAPGQSGLCEAWGSRASETVMVHQATTSSWVAGSGNRQLAHKETADSENSDIQSLLSLTSEEYTDDIPLLKEA

SEQ ID NO: 10943 - protein, 823 aa, Artificial Sequence
  Description of Artificial Sequence: Synthetic coding sequence
MFYVIGGITVSVVAFFFTIKFLFELAARVVSFLQNEDRERRGDRTIYDYVRGNYLDPRSCKVSWDWKDPYEVGHSMAFRVHLFYKNGQPFPAHRPVGLRVHISHVELAVEIPVTQEVLQEPNSNVVKVAFTVRKAGRYEITVKLGGLNVAYSPYYKIFQPGMVVPSKTKIVCHFSTLVLTCGQPHTLQIVPRDEYDNPTNNSMSLRDEHNYTLSIHELGPQEEESTGVSFEKSVTSNRQTFQVFLRLTLHSRGCFHACISYQNQPINNGEFDIIVLSEDEKNIVERNVSTSGVSIYFEAYLYNATNCSSTPWHLPPMHMTSSQRRPSTAVDEEDEDSPSECHTPEKVKKPKKVYCYVSPKQFSVKEFYLKIIPWRLYTFRVCPGTKFSYLGPDPVHKLLTLVVDDGIQPPVELSCKERNILAATFIRSLHKNIGGSETFQDKVNFFQRELRQVHMKRPHSKVTLKVSRHALLESSLKATRNFSISDWSKNFEVVFQDEEALDWGGPRREWFELICKALFDTTNQLFTRFSDNNQALVHPNPNRPAHLRLKMYEFAGRLVGKCLYESSLGGAYKQLVRARFTRSFLAQIIGLRMHYKYFETDDPEFYKSKVCFILNNDMSEMELVFAEEKYNKSGQLDKVVELMTGGAQTPVTNANKIFYLNLLAQYRLASQVKEEVEHFLKGLNELVPENLLAIFDENELELLMCGTGDISVSDFKAHAVVVGGSWHFREKVMRWFWTVVSSLTQEELARLLQFTTGSSQLPPGGFAALCPSFQIIAAPTHSTLPTAHTCFNQLCLPTYDSYEEVHRMLQLAISEGCEGFGML

SEQ ID NO: 10944 - protein, 1049 aa, Artificial Sequence
  Description of Artificial Sequence: Synthetic coding sequence
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 10945 - protein, 1609 aa, Artificial Sequence
  Description of Artificial Sequence: Synthetic coding sequence
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 10946 - protein, 1403 aa, Artificial Sequence
  Description of Artificial Sequence: Synthetic coding sequence
MANCSQEELDEEFEQFMKELSDDSFENSDKTARQSKKEMKKKDTVPWWITEDDFKDDGLLGTNVSYLKTKKTSQPVMEIEEESAEKIQFLKSSGTSLLSTDSLETNELVVSELNHSSLGVGLDTLEEQEEKEQFFARLEKGLTSSIDYSRLNKELDSNDSTHFKALHSNQANAELTDDEHENESKHEELAENYSDDFEDEYVGAPLTTKDEEMPSKENSKSEKISVPKQEEEKTGMLANVVLLDSLDSVAEVNLDEQDKITPKPRCLPEMTENEMTGTGVSYGQSSSDVEALHQAYCHIAHSLGDEDKQKIESNTVEDIKSSVKGHPQENEENSKNISTMESDLPTVEELMKPIRIDSFGISGFDLQPVSSEKVAERKETEFFSSLPLKMNPNILSQDSQHVNLFFDKNDENVILQKTTNESMENSCPQVTEVTATEEHVDKMYLNILRKKITVNSSSLSQDDKINKTYRSQLSSEEEGAVMGKQVPYKKARSAPPLLKRKPQSGLYASVRSSGYGKPSSPLKMFSTLEKKTSEDIIKSKNLRSISTSNQPRKKEILSGTKLIKPAALDKPAHKTESCLSTRKKSENPTETDSCIQFQTDSLGYCGENKEKKLLMFKRVQEAEDKWRGAQALIEQIKATFSEKEKELENKLEELKKQQEKELFKLNQDNYILQAKLSSFEETNKKQRWLHFGEAADPVTGEKLKQIQKEIQEQETLLQGYQQENERLYNQVKDLQEQNKKNEERMFKENQSLFSEVASLKEQMHKSRFLSQVVEDSEPTRNQNFTDLLAELRMAQKEKDSLLEDIKRLKQDKQALEVDFEKMKKERDQAKDQIAYVTGEKLYEIKILEETHKQEISRLQKRLQWYAENQELLDKDALRLREANEEIEKLKLEIEKLKAESGNPSIRQKIRLKDKAADAKKIQDLERQVKEMEGILKRRYPNSLPALILAASAAGDTVDKNTVEFMEKRIKKLEADLEGKDEDAKKSLRTMEQQFQKMKIQYEQRLEQQEQLLACKLNQHDSPRIKALEKELDDIKEAHQITVRNLEAEIDVLKHQNAELDVKKNDKDDEDFQSIEFQVEQAHAKAKLVRLNEELAAKKREIQDLSKTVERLQKDRRMMLSNQNSKGREEMSAKRAKKDVLHSSKGNANSFPGTLDSKLYQPHTFTDSHVSEVLQENYRLKNELEGLISEKNELKMKSEAVMNQFENSMRRVKEDTAAHIASLKASHQREIEKLLCQNAVENSSSKVAELNRKIATQEVLIRHFQSQVNELQSKQESLVVSEVREEILQKEITKLLEELREAKENHTPEMKHFVGLEKKIKQMEMRHAQREQELQQIIQQTHQVVETEQNKEVEKWKRLAQLKNRELEKFRTELDSILDVLRELHRQGVVVPVAFADEMNAPEY

SEQ ID NO: 10947 - protein, 916 aa, Artificial Sequence
  Description of Artificial Sequence: Synthetic coding sequence
METSQETSLFLVKILEELDSKQNTVSYQDLCKSLCARFDLSQLAKLRSVLFYTACLDPNFPATLFKDKMKCTVNNQQSKKIMVAADIVTIFNLIQMNGGAAKEKLPTGRQKVRKKEASFESCRSDTEICNAAECEPLNCELSERSFSRGYPIRQSSKCRKMDCKDCPQFVPASEPNFLLGVSKEVKNRAASLDRLQALAPYSVTSPQPCEMQRTYFPMNIENESISDQDSLPINQSIKETFISNEEPFVVQSCVQKRNIFKEDFHNLMAVSPSLVGPISKAENEHREPQSRKEPHKPPFFNHSFEMPYNSQYLNPVYSPVPDKRRAKHESLDDLQASTYFGPTPVMGTQEARRCLGKPNKQTPWPAKSWSLNTEEVPDFERSFFNRNPSEEKLHYPNASSQTPNFPAPERRPTYLVPKDQQPILPIAYAAKQNGLKSKEISSPVDLEKHEPVKKFKDKSINCTSGQLSSDTSSVGTQTEHVLEPKKCRDLCTSGQGKYSDRHTMKHSDDDSEIVSDDISDIFRFLDDMSISGSTGVIQSSCYNSTGSLSQLHKSDCDSSPEHNLTKIANGVPNSKGDKGNRPENTHHSEEELKTSVCKLVLRIGEIERKLESLSGVRDEISQVLGKLNKLDQKMQQPEKVSVQIDLNSLTSEGPSDDSASPRMFHAHSGSHGPKLENNPDWCCSDASGSNSESLRVKALKKSLFTRPSSRSLTEENSATESKIASISNSPRDWRTITYTNRVGLNEEEIKDTGPGDNKDWHRKSKEADRQYDIPPQHRLPKQPKDGFLVEQVFSPHPYPASLKAHMKSNPLYTDMRLTELAEVKRGQPSWTIEEYARNAGDKGKLTALDLQTQESLNPNNLEYWMEDIYTPGYDSLLKRKEAEFRRAKVCKIAALIAAAACTVILVIVVPICTMKS

SEQ ID NO: 10948 - protein, 2177 aa, Artificial Sequence
  Description of Artificial Sequence: Synthetic coding sequence
MEEILRKLQKEASGSKYKAIKESCTWALETLGGLDTIVKIPPHVLREKCLLPLQLALESKNVKLAQHALAGMQKLLSEERFVSMETDSDEKQLLNQILNAVKVTPSLNEDLQVEVMKVLLCITYTPTFDLNGSAVLKIAEVCIETYISSCHQRSINTAVRATLSQMLSDLTLQLRQRQENTIIENPDVPQDFGNQGSTVESLCDDVVSVLTVLCEKLQAAINDSQQLQLLYLECILSVLSSSSSSMHLHRRFTDLIWKNLCPALIVILGNPIHDKTITSAHTSSTSTSLESDSASPGVSDHGRGSGCSCTAPALSGPVARTIYYIAAELVRLVGSVDSMKPVLQSLYHRVLLYPPPQHRVEAIKIMKEILGSPQRLCDLAGPSSTESESRKRSISKRKSHLDLLKLIMDGMTEACIKGGIEACYAAVSCVCTLLGALDELSQGKGLSEGQVQLLLLRLEELKDGAEWSRDSMEINEADFRWQRRVLSSEHTPWESGNERSLDISISVTTDTGQTTLEGELGQTTPEDHSGNHKNSLKSPAIPEGKETLSKVLETEAVDQPDVVQRSHTVPYPDITNFLSVDCRTRSYGSRYSESNFSVDDQDLSRTEFDSCDQYSMAAEKDSGRSDVSDIGSDNCSLADEEQTPRDCLGHRSLRTAALSLKLLKNQEADQHSARLFIQSLEGLLPRLLSLSNVEEVDTALQNFASTFCSGMMHSPGFDGNSSLSFQMLMNADSLYTAAHCALLLNLKLSHGDYYRKRPTLAPGVMKDFMKQVQTSGVLMVFSQAWIEELYHQVLDRNMLGEAGYWGSPEDNSLPLITMLTDIDGLESSAIGGQLMASAATESPFAQSRRIDDSTVAGVAFARYILVGCWKNLIDTLSTPLTGRMAGSSKGLAFILGAEGIKEQNQKERDAICMSLDGLRKAARLSCALGVAANCASALAQMAAASCVQEEKEEREAQEPSDAITQVKLKVEQKLEQIGKVQGVWLHTAHVLCMEAILSVGLEMGSHNPDCWPHVFRVCEYVGTLEHNHFSDGASQPPLTISQPQKATGSAGLLGDPECEGSPPEHSPEQGRSLSTAPVVQPLSIQDLVREGSRGRASDFRGGSLMSGSSAAKVVLTLSTQADRLFEDATDKLNLMALGGFLYQLKKASQSQLFHSVTDTVDYSLAMPGEVKSTQDRKSALHLFRLGNAMLRIVRSKARPLLHVMRCWSLVAPHLVEAACHKERHVSQKAVSFIHDILTEVLTDWNEPPHFHFNEALFRPFERIMQLELCDEDVQDQVVTSIGELVEVCSTQIQSGWRPLFSALETVHGGNKSEMKEYLVGDYSMGKGQAPVFDVFEAFLNTDNIQVFANAATSYIMCLMKFVKGLGEVDCKEIGDCAPAPGAPSTDLCLPALDYLRRCSQLLAKIYKMPLKPIFLSGRLAGLPRRLQEQSASSEDGIESVLSDFDDDTGLIEVWIILLEQLTAAVSNCPRQHQPPTLDLLFELLRDVTKTPGPGFGIYAVVHLLLPVMSVWLRRSHKDHSYWDMASANFKHAIGLSCELVVEHIQSFLHSDIRYESMINTMLKDLFELLVACVAKPTETISRVGCSCIRYVLVTAGPVFTEEMWRLACCALQDAFSATLKPVKDLLGCFHSGTESFSGEGCQVRVAAPSSSPSAEAEYWRIRAMAQQVFMLDTQCSPKTPNNFDHAQSCQLIIELPPDEKPNGHTKKSVSFREIVVSLLSHQVLLQNLYDILLEEFVKGPSPGEEKTIQVPEAKLAGFLRYISMQNLAVIFDLLLDSYRTAREFDTSPGLKCLLKKVSGIGGAANLYRQSAMSFNIYFHALVCAVLTNQETITAEQVKKVLFEDDERSTDSSQQCSSEDEDIFEETAQVSPPRGKEKRQWRARMPLLSVQPVSNADWVWLVKRLHKLCMELCNNYIQMHLDLENCMEEPPIFKGDPFFILPSFQSESSTPSTGGFSGKETPSEDDRSQSREHMGESLSLKAGGGDLLLPPSPKVEKKDPSRKKEWWENAGNKIYTMAADKTISKLMTEYKKRKQQHNLSAFPKEVKVEKKGEPLGPRGQDSPLLQRPQHLMDQGQMRHSFSAGPELLRQDKRPRSGSTGSSLSVSVRDAEAQIQAWTNMVLTVLNQIQILPDQTFTALQPAVFPCISQLTCHVTDIRVRQAVREWLGRVGRVYDIIV

SEQ ID NO: 10949 - protein, 1013 aa, Artificial Sequence
  Description of Artificial Sequence: Synthetic coding sequence
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSCHQCDPDKYSEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGLDMDL

SEQ ID NO: 10950 - protein, 622 aa, Artificial Sequence
  Description of Artificial Sequence: Synthetic coding sequence
MATVLSRALKLPGKKSPDLGEYDPLTQADSDESEDDLVLNLQKNGGVKNGKSPLGEAPEPDSDAEVAEAAKPHLSEVTTEGYPSEPLGGLEQKAASSLVSYVRTSVFLLTLGISMILVLLCAFLIPCPPRDLHSTWSRHLGSQGGGDLSPLELADVNGDGLRDVLLSFVMSRNGSAVGVSRPAANLVCLSGMNGSTLWSSLLPEEARDITCLELMPGSLAETICLVTGTHKMLSAFNATSGKAIWTLNPNYLSNGTLAAPVVVLPDLDEDGVRDLVVLAIGELQPDLCFLLVSGRTGNPVGRPVKYNIVGVGNLIGPQVYITTNGAVYILFGFGNIQAVALRDIFVQAQNRDSSPPSLQIEEPEWEKRRSINLSELIDVYSDGVELLQMVKAPDSNCSNLLITTRQSLVLLRGQNLTPYWALRLQGLRSQPTPGYFTDDQTLDFLLQIQDGVGMKKMMVVDGDSGSIVWSYRAPCHMKETPATSAVTSDQKSVFLFWAEGLSAASPNSDIILGTEPPSLHHLYLLHPAFPSILLDLANTTGTVTASEVGINDLWKDAFYVTRTTGPSSEGHPAALVVSKLSLRWALMEGQMAQLQESTPKIGRGELRRFLSRIKFVEAPYEI

SEQ ID NO: 10951 - protein, 622 aa, Artificial Sequence; identical to SEQ ID NO: 10950
  Description of Artificial Sequence: Synthetic coding sequence

SEQ ID NO: 10952 - protein, 199 aa, Artificial Sequence
  Description of Artificial Sequence: Synthetic coding sequence
MTSCGQQSLNVLAVLFSLLFSAVLSAHFRVCEPYTDHKGRYHFGFHCPRLSDNKTFILCCHHNNTVFKYCCNETEFQAVMQANLTASSEGYMHNNYTALLGVWIYGFFVLMLLVLDLLYYSAMNYDICKVYLARWGIQGRWMKQDPRRWGNPARAPRPGQRAPQPQPPPGPLPQAPQAVHTLRGDAHSPPLMTFQSSSA

SEQ ID NO: 10953 - protein, 1180 aa, Artificial Sequence
  Description of Artificial Sequence: Synthetic coding sequence
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSLPQVCPGPAMAKTPPQMHPVTTPAKNPLQTCLSATMSKTSSQRSPVGVTKPSPQTRLPAMITKTPAQLRSVATILKTLCLASPTVANVKAPPQVAVAAGTPNTSGSIHENPPKAKATVNVKQAAKVVKASSPSYLAEGKIRCLAQPHPGTGVPRAAAELPLEAEKIKTGTQKQAKTDMAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 10954 - protein, 1801 aa, Artificial Sequence
  Description of Artificial Sequence: Synthetic coding sequence
MSDDIRKRFEFPNSLIQSQAVGHLIAAVLKENGFSEKIHQSTNQTPALNLLWEKCCSDNVVVRTACCEGLVALVAQDHAEFSYVLNGILNLIPSTRNTHGLIKAIMHLLQMQALKEGQGGEKNIQSIYTIRNHPHPLITVLEHRPDCWPVFLQQLTAFFQQCPERLEVSCIQIMAPFLWYLYCEPSQLQEYAKLRLALLKVLLQPQVLCDKDQPSILEQQILQLCCDIVPCLQVKDLIQTTEAMMFIEEVCLSLLRHPVFWKIQLTQMSLQLLCVSEVSLKITGECSSSIHLLEHSVELLKEDFPVELVIIGIALLLLQTPASQQKPILNLALKLLSVTEDQKIPKSSLLLVMPILQILSSTALEDCISVDEEGPSRQQLALNLLEMIQQECYRDDHQKLSYKLVCPVTSMYGTIFTAWRILEVMTDSSAASDWLASVESLLPITAVIPAPAFLLLAHLLVEDKGQNLHQILKVTTELAQADSSQVPNLIPVLMFKLGRPLEPILYNDILYTLPKLGVHKVCIGQILRIIQLLGTTPRLRAVTLRLLTSLWEKQDRVYPELQRFMAVSDVPSLSVGKEVQWEKLIAKAASIRDICKQRPYQHGADMLAAISQVLNECTKPDQATPAALVLQGLHALCQAEVVCIRSTWNALSPKLSCDTRPLILKTLSELFSLVPSLTVNTTEYENFKVQVLSFLWTHTQNKDPIVANAAYRSLANFTAGEHTILHLPEKIRPEIPIPEELDDDEDVEDVDLSVPGSCYLKLLSLTPPLVLPALEEFFTSLVKQEMVNMPRGIYHSALKGGARSDQGKTVAGIPNFILKMYETNKQPGLKPGLAGGMLFCYDVSMYQSKDGKPLNRLMASRGRSFKQTSLALVHEVHIQLSEWHRAIFLPQAWLAYMNRAYHAILQGRLGELELQLKHGKEEPEEVQYKKSTAWLWVRDMLTDEITKAAAKESPVVKGNALLALSSLAVVVSRHEASLSSDSDGLLEVQPNFLSMKEWVSMVLDTLLVIVDSHYQPRGQLLSWFYYKSYSGENTASAIARSAAATALSLLVPVFIISCKEKVEEILNMLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTEGTPTMLCLAALHGMVALVGSEGDVMQLKSEAIQTSHFQGRLNEVIRTLTQVISVSGVIGLQSNAVWLLGHLHLSTLSSSQSRASVPTDYSYLPESSFIGAAIGFFITGGKKGPESVPPSLLKVVMKPIATVGESYQYPPVNWAALLSPLMRLNFGEEIQQLCLEIMVTQAQSSQNAAALLGLWVTPPLIHSLSLNTKRYLLISAPLWIKHISDEQILGFVENLMVAVFKAASPLGSPELCPSALHGLSQAMKLPSPAHHLWSLLSEATGKIFDLLPNKIRRKDLELYISIAKCLLEMTDDDANRIAQVTKSNIEKAAFVKLYLVSQGRFPLVNLTDMLSVAVQHREKEVLAWMILHSLYQARIVSHANTGVLKRMEWLLELMGYIRNVAYQSTSFHNTALDKALDFFLLIFATAVVAWADHTAPLLLGLSASWLPWHQENGPAGPVPSFLGRSPMHRVTLQEVLTLLPNSMALLLQKEPWKEQTQKFIDWLFSIMESPKEALSAQSRDLLKATLLSLRVLPEFKKKAVWTRAYGW

SEQ ID NO: 10955 - protein, 1801 aa, Artificial Sequence; identical to SEQ ID NO: 10954
  Description of Artificial Sequence: Synthetic coding sequence

SEQ ID NO: 10956 - protein, 518 aa, Artificial Sequence
  Description of Artificial Sequence: Synthetic coding sequence
MLCASFLGLGLSVAIVGPTFQDLATNVNRNISSLSFIFVGRALGYLSGSVIGGFLVDVMNYFLLLGISMSATTVGLYLVPFCKTAILLTVMMSIFGVSIGILDTGGNVLILAIWGDKGAPHMQALHFSFALGAFLAPLLAKLALGPTASAENHTESDFHPALNQSSDADSEALFGVPNDKNLLWAYAVIGTYMFLVSVIFFCLFLKNSSKQEKARASAETFRRAKYHNALLCLLFLFFFFYVGAEVTYGSYVFSFATTHAGMKESEAAGLNSIFWGTFAACRGLAIFFATCLQPGTMIVLSNIGSLTSSLFLVLFDKNPICLWIATSVYGASMATTFPSGVSWIEQYTTIHGKSAAFFVIGASLGEMAIPAVIGILQGKYPDLPVVLYTSLGASIATGILFPVLYKLATSPLDRQRKEDRKSEDQKALLSSSGLNEYEEENEEEDAEKWNEMDFEMIETNDTMRHSIIETSRSSLTEPTAEVYNQYPSNALVFESSPFNTGSAHVKHLPETRTKGTNV

SEQ ID NO: 10957 - protein, 634 aa, Artificial Sequence
  Description of Artificial Sequence: Synthetic coding sequence
MWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKVGAPGILQGMVLSFGGLQFTENHLQFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKEDPSV

SEQ ID NO: 10958 - protein, 410 aa, Artificial Sequence
  Description of Artificial Sequence: Synthetic coding sequence
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRHLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 10959 - protein, 207 aa, Artificial Sequence
  Description of Artificial Sequence: Synthetic coding sequence
MENEDGYMTLSFKNRCKSKQKSKDFSLYPQYYCLLLIFGCIVILIFIMTGIDLKFWHKKMDFSQNVNVSSLSGHNYLCPNDWLLNEGKCYWFSTSFKTWKESQRDCTQLQAHLLVIQNLDELEFIQNSLKPGHFGWIGLYVTFQGNLWMWIDEHFLVPELFSVIGPTDDRSCAVITGNWVYSEDCSSTFKGICQRDAILTHNGTSGV

SEQ ID NO: 10960 - protein, 409 aa, Artificial Sequence
  Description of Artificial Sequence: Synthetic coding sequence
MEESWEAAPGGQAGAELPMEPVGSLVPTLEQPQVPAKVRQPEGPESSPSPAGAVEKAAGAGLEPSSKKKPPSPRPGSPRVPPLSLGYGVCPEPPSPGPALVKLPRNGEAPGAEPAPSAWAPMELQVDVRVKPVGAAGGSSTPSPRPSTRFLKVPVPESPAFSRHADPAHQLLLRAPSQGGTWGRRSPLAAARTESGCDAEGRASPAEGSAGSPGSPTCCRCKELGLEKEDAALLPRAGLDGDEKLPRAVTLTGLPMYVKSLYWALAFMAVLLAVSGVVIVVLASRAGARCQQCPPGWVLSEEHCYYFSAEAQAWEASQAFCSAYHATLPLLSHTQDFLGRYPVSRHSWVGAWRGPQGWHWIDEAPLPPQLLPEDGEDNLDINCGALEEGTLVAANCSTPRPWVCAKGTQ

SEQ ID NO: 10961 - protein, 314 aa, Artificial Sequence
  Description of Artificial Sequence: Synthetic coding sequence
MEESWEAAPGGQAGAELPMEPVGSLVPTLEQPQVPAKVRQPEGPESSPSPAGAVEKAAGAGLEPSSKKKPPSPRPGSPRVPPLSLGYGVCPEPPSPGPALVKLPRNGEAPGAEPAPSAWAPMELQVDVRVKPVGAAGGSSTPSPRPSTRFLKVPVPESPAFSRHADPAHQLLLRAPSQGGTWGRRSPLAAARTESGCDAEGRASPAEGSAGSPGSPTCCRCKELGLEKEDAALLPRAGLDGDEKLPRAVTLTDSLRTARTIWISTVGPWRKARWWLQTAALQDPGSVPRGPSDLGSAWSSACQADAAPPTGEAS

SEQ ID NO: 10962 - protein, 757 aa, Artificial Sequence
  Description of Artificial Sequence: Synthetic coding sequence
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 10963 - protein, 593 aa, Artificial Sequence
  Description of Artificial Sequence: Synthetic coding sequence
MGQGLKAWPRYRVVGSADAGQYNLEITDAELSDDASYECQATEAALRSRRAKLTVLNPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 10964 - protein, 773 aa, Artificial Sequence
  Description of Artificial Sequence: Synthetic coding sequence
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMGPRPPGSPPEAALSAQVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 10965 - protein, 654 aa, Artificial Sequence
  Description of Artificial Sequence: Synthetic coding sequence
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLNPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 10966 - protein, 657 aa, Artificial Sequence
  Description of Artificial Sequence: Synthetic coding sequence
MLSLLVWILTLSDTFSQVPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 10967 - protein, 1771 aa, Artificial Sequence
  Description of Artificial Sequence: Synthetic coding sequence
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLEVIKEDAAEGLSSPTDSSRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 10968 - protein, 1031 aa, Artificial Sequence
  Description of Artificial Sequence: Synthetic coding sequence
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLQYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERCCGADSCDRDRIGISKSVLVAMLMES

SEQ ID NO: 10969 - protein, 1672 aa, Artificial Sequence
  Description of Artificial Sequence: Synthetic coding sequence
MIAAEQGNLEIVKELIKNGANCNLEDLDNWTALISASKEGHVHIVEELLKCGVNLEHRDMGGWTALMWACYKGRTDVVELLLSHGANPSVTGLYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 10970 - protein, 1752 aa, Artificial Sequence
  Description of Artificial Sequence: Synthetic coding sequence
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 10971 - protein, 1752 aa, Artificial Sequence; identical to SEQ ID NO: 10970
  Description of Artificial Sequence: Synthetic coding sequence

SEQ ID NO: 10972 - protein, 994 aa, Artificial Sequence
  Description of Artificial Sequence: Synthetic coding sequence
MVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQEENAGLEIDSSSEDPD

SEQ ID NO: 10973 - protein, 1317 aa, Artificial Sequence
  Description of Artificial Sequence: Synthetic coding sequence
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQIALLDSPTALSMEEKLQQNEARVQELTKEWTNKWNETQNILKEQTLALRKEGIGVVLDSELPHLIGIDDDLLSTGIILYHLKEGQTYVGRDDASTEQDIVLHGLDLESEHCIFENIGGTVTLIPLSGSQCSVNGVQIVEATHLNQGAVILLGRTNMFRFNHPKEAAKLREKRKSGLLSSFSLSMTDLSKSRENLSAVMLYNPGLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKRLEEQEKEQVMLVAHLEEQLREKQEMIQLLRRGEVQWVEEEKRDLEGIRESLLRVKEARAGGDEDGEELEKAQLRFFEFKRRQLVKLVNLEKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYERMVSRSLGANPDDLKDPIKISIPRYVLCGQGKDAHFEFEVKITVLDETWTVFRRYSRFREMHKTLKLKYAELAALEFPPKKLFGNKDERVIAERRSHLEKYLRDFFSVMLQSATSPLHINKVGLTLSKHTICEFSPFFKKGVFDYSSHGTG

SEQ ID NO: 10974 - protein, 1287 aa, Artificial Sequence
  Description of Artificial Sequence: Synthetic coding sequence
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQIALLDSPTALSMEEKLQQNEARVQELTKEWTNKWNETQNILKEQTLALRKEGIGVVLDSELPHLIGIDDDLLSTGIILYHLKEGQTYVGRDDASTEQDIVLHGLDLESEHCIFENIGGTVTLIPLSGSQCSVNGVQIVEATHLNQGAVILLGRTNMFRFNHPKEAAKLREKRKSGLLSSFSLSMTDLSKSRENLSAVMLYNPGLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKRLEEQEKEQVMLVAHLEEQLREKQEMIQLLRRGEVQWVEEEKRDLEGIRESLLRVKEARAGGDEDGEELEKAQLRFFEFKRRQLVKLVNLEKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYERMVSRSLGANPDDLKDPIKISIPRYVLCGQGKDAHFEFEVKLAALEFPPKKLFGNKDERVIAERRSHLEKYLRDFFSVMLQSATSPLHINKVGLTLSKHTICEFSPFFKKGVFDYSSHGTG

SEQ ID NO: 10975 - protein, 1161 aa, Artificial Sequence
  Description of Artificial Sequence: Synthetic coding sequence
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQIALLDSPTALSMEEKLQQNEARVQELTKEWTNKWNETQNILKEQTLALRKEGIGVVLDSELPHLIGIDDDLLSTGIILYHLKEGQTYVGRDDASTEQDIVLHGLDLESEHCIFENIGGTVTLIPLSGSQCSVNGVQIVEATHLNQGAVILLGRTNMFRFNHPKEAAKLREKRKSGLLSSFSLSMTDLSKSRENLSAVMLYNPGLEFERQQREELEKLESKRKLIEEMEEKQKSDKAELERMQQEVETQRKETEIVQLQIRKQEESLKRRSFHIENKLKDLLAEKEKFEEERLKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYERMVSRSLGANPDDLKDPIKISIPRYVLCGQGKDAHFEFEVKITVLDETWTVFRRYSRFREMHKTLKLKYAELAALEFPPKKLFGNKDERVIAERRSHLEKYLRDFFSVMLQSATSPLHINKVGLTLSKHTICEFSPFFKKGVFDYSSHGTG

SEQ ID NO: 10976 - protein, 502 aa, Artificial Sequence
  Description of Artificial Sequence: Synthetic coding sequence
MIQLLRRGEVQWVEEEKRDLEGIRESLLRVKEARAGGDEDGEELEKAQLRFFEFKRRQLVKLVNLEKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYEITVLDETWTVFRRYSRFREMHKTLKLKYAELAALEFPPKKLFGNKDERVIAERRSHLEKYLRDFFSVMLQSATSPLHINKVGLTLSKHTICEFSPFFKKGVFDYSSHGTG

SEQ ID NO: 10977 - protein, 1392 aa, Artificial Sequence
  Description of Artificial Sequence: Synthetic coding sequence
MASVKVAVRVRPMNRREKDLEAKFIIQMEKSKTTITNLKIPEGGTGDSGRERTKTFTYDFSFYSADTKSPDYVSQEMVFKTLGTDVVKSAFEGYNACVFAYGQTGSGKSYTMMGNSGDSGLIPRICEGLFSRINETTRWDEASFRTEVSYLEIYNERVRDLLRRKSSKTFNLRVREHPKEGPYVEDLSKHLVQNYGDVEELMDAGNINRTTAATGMNDVSSRSHAIFTIKFTQAKFDSEMPCETVSKIHLVDLAGSERADATGATGVRLKEGGNINKSLVTLGNVISALADLSQDAANTLAKKKQVFVPYRDSVLTWLLKDSLGGNSKTIMIATISPADVNYGETLSTLRYANRAKNIINKPTINEDANVKLIRELRAEIARLKTLLAQGNQIALLDSPTALSMEEKLQQNEARVQELTKEWTNKWNETQNILKEQTLALRKEGIGVVLDSELPHLIGIDDDLLSTGIILYHLKEGQTYVGRDDASTEQDIVLHGLDLESEHCIFENIGGTVTLIPLSGSQCSVNGVQIVEATHLNQGAVILLGRTNMFRFNHPKEAAKLREKRKSGLLSSFSLSMTDLSKSRENLSAVMLYNPGLEFERQQREELEKLESKRKLIEEMEEKQKSDKAELERMQQEVETQRKETEIVQLQIRKQEESLKRRSFHIENKLKDLLAEKEKFEEERLREQQEIELQKKRQEEETFLRVQEELQRLKELNNNEKAEKFQIFQELDQLQKEKDEQYAKLELEKKRLEEQEKEQVMLVAHLEEQLREKQEMIQLLRRGEVQWVEEEKRDLEGIRESLLRVKEARAGGDEDGEELEKAQLRFFEFKRRQLVKLVNLEKDLVQQKDILKKEVQEEQEILECLKCEHDKESRLLEKHDESVTDVTEVPQDFEKIKPVEYRLQYKERQLQYLLQNHLPTLLEEKQRAFEILDRGPLSLDNTLYQVEKEMEEKEEQLAQYQANANQLQKLQATFEFTANIARQEEKVRKKEKEILESREKQQREALERALARLERRHSALQRHSTLGMEIEEQRQKLASLNSGSREQSGLQASLEAEQEALEKDQERLEYEIQQLKQKIYEVDGVQKDHHGTLEGKVASSSLPVSAEKSHLVPLMDARINAYIEEEVQRRLQDLHRVISEGCSTSADTMKDNEKLHNGTIQRKLKYELCRDLLCVLMPEPDAAACANHPLLQQDLVQLSLDWKTEIPDLVLPNGVQVSSKFQTTLVDMIYFLHGNMEVNVPSLAEVQLLLYTTVKVMGDSGHDQCQSLVLLNTHIALVKEDCVFYPRIRSRNIPPPGAQFDVIKCHALSEFRCVVVPEKKNVSTVELVFLQKLKPSVGSRNSPPEHLQEAPNVQLFTTPLYLQGSQNVAPEVWKLTFNSQDEALWLISHLTRL

SEQ ID NO: 10978 - protein, 898 aa, Artificial Sequence
  Description of Artificial Sequence: Synthetic coding sequence
MSVTEEDLCHHMKVVVRVRPENTKEKAAGFHKVVHVVDKHILVFDPKQEEVSFFHGKKTTNQNVIKKQNKDLKFVFDAVFDETSTQSEVFEHTTKPILRSFLNGYNCTVLAYGATGAGKTHTMLGSADEPGVMYLTMLHLYKCMDEIKEEKICSTAVSYLEVYNEQIRDLLVNSGPLAVREDTQKGVVVHGLTLHQPKSSEEILHLLDNGNKNRTQHPTDMNATSSRSHAVFQIYLRQQDKTASINQNVRIAKMSLIDLAGSERASTSGAKGTRFVEGTNINRSLLALGNVINALADSKRKNQHIPYRNSKLTRLLKDSLGGNCQTIMIAAVSPSSVFYDDTYNTLKYANRAKDIKSSLKSNVLNVNNHITQYVKICNEQKAEILLLKEKLKAYEEQKAFTNENDQAKLMISNPQEKEIERFQEILNCLFQNREEIRQEYLKLEMLLKENELKSFYQQQCHKQIEMMCSEDKVEKATGKRDHRLAMLKTRRSYLEKRREEELKQFDENTNWLHRVEKEMGLLSQNGHIPKELKKDLHCHHLHLQNKDLKAQIRHMMDLACLQEQQHRQTEAVLNALLPTLRKQYCTLKEAGLSNAAFESDFKEIEHLVERKKVVVWADQTAEQPKQNDLPGISVLMTFPQLGPVQPIPCCSSSGGTNLVKIPTEKRTRRKLMPSPLKGQHTLKSPPSQSVQLNDSLSKELQPIVYTPEDCRKAFQNPSTVTLMKPSSFTTSFQAISSNINSDNCLKMLCEVAIPHNRRKECGQEDLDSTFTICEDIKSSKCKLPEQESLPNDNKDILQRLDPSSFSTKHSMPVPSMVPSYMAMTTAAKRKRKLTSSTSNSSLTADVNSGFAKRVRQDNSSEKHLQENKPTMEHKRNICKINPSMVRKFGRNISKGNLR

SEQ ID NO: 10979 - protein, 492 aa, Artificial Sequence
  Description of Artificial Sequence: Synthetic coding sequence
MAPPAARLALLSAAALTLAARPAPSPGLGPGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWTVYGLATLLILTVTAIVAKILLHVTFKSHRVPASGDLRDCHQPGTSGEIWSIFYKPSTSISIFKKKLKGQSQQDDRNPLAIQDSEVTSLIWSQGQPRSI

SEQ ID NO: 10980 - protein, 458 aa, Artificial Sequence
  Description of Artificial Sequence: Synthetic coding sequence
MAPPAARLALLSAAALTLAARPAPSPGLGPGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGWTVYGLATLLILTVTAIVAKILLHVTFKSHRVPASGDLRDCHQPGTSGEIWSIFYKPSTSISIFKKKLKGQSQQDDRNPLVSD

SEQ ID NO: 10981 - protein, 475 aa, Artificial Sequence
  Description of Artificial Sequence: Synthetic coding sequence
MAPPAARLALLSAAALTLAARPAPSPGLGPGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWTVYGLATLLILTVTAIVAKILLHVTFKSHRVPASGDLRDCHQPGTSGEIWSIFYKPSTSISIFKKKLKGQSQQDDRNPLVSD

SEQ ID NO: 10982 - protein, 473 aa, Artificial Sequence
  Description of Artificial Sequence: Synthetic coding sequence
MAPPAARLALLSAAALTLAARPAPSPGLGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWTVYGLATLLILTVTAIVAKILLHVTFKSHRVPASGDLRDCHQPGTSGEIWSIFYKPSTSISIFKKKLKGQSQQDDRNPLVSD

SEQ ID NO: 10983 - protein, 288 aa, Artificial Sequence
  Description of Artificial Sequence: Synthetic coding sequence
MAAVLQRVERLSNRVVRVLGCNPGPMTLQGTNTYLVGTGPRRILIDTGEPAIPEYISCLKQALTEFNTAIQEIVVTHWHRDHSGGIGDICKSINNDTTYCIKKLPRNPQREEIIGNGEQQYVYLKDGDVIKTEGATLRVLYTPGHTDDHMALLLEEENAIFSGDCILGEGTTVFEDLYDYMNSLKELLKIKADIIYPGHGPVIHNAEAKIQQYISHRNIREQQILTLFRENFEKSFTVMELVKIIYKNTPENLHEMAKHNLLLHLKKLEKEGKIFSNTDPDKKWKAHL

SEQ ID NO: 10984 - protein, 288 aa, Artificial Sequence; identical to SEQ ID NO: 10983
  Description of Artificial Sequence: Synthetic coding sequence

SEQ ID NO: 10985 - protein, 567 aa, Artificial Sequence
  Description of Artificial Sequence: Synthetic coding sequence
MKPVWVATLLWMLLLVPRLGAARKGSPEEASFYYGTFPLGFSWGVGSSAYQTEGAWDQDGKGPSIWDVFTHSGKGKVLGNETADVACDGYYKVQEDIILLRELHVNHYRFSLSWPRLLPTGIRAEQVNKKGIEFYSDLIDALLSSNITPIVTLHHWDLPQLLQVKYGGWQNVSMANYFRDYANLCFEAFGDRVKHWITFSDPRAMAEKGYETGHHAPGLKLRGTGLYKAAHHIIKAHAKAWHSYNTTWRSKQQGLVGISLNCDWGEPVDISNPKDLEAAERYLQFCLGWFANPIYAGDYPQVMKDYIGRKSAEQGLEMSRLPVFSLQEKSYIKGTSDFLGLGHFTTRYITERNYPSRQGPSYQNDRDLIELVDPNWPDLGSKWLYSVPWGFRRLLNFAQTQYGDPPIYVMENGASQKFHCTQLCDEWRIQYLKGYINEMLKAIKDGANIKGYTSWSLLDKFEWEKGYSDRYGFYYVEFNDRNKPRYPKASVQYYKKIIIANGFPNPREVESWYLKALETCSINNQMLAAEPLLSHMQMVTEIVVPTVCSLCVLITAVLLMLLLRRQS

SEQ ID NO: 10986 - protein, 394 aa, Artificial Sequence
  Description of Artificial Sequence: Synthetic coding sequence
MANYFRDYANLCFEAFGDRVKHWITFSDPRAMAEKGYETGHHAPGLKLRGTGLYKAAHHIIKAHAKAWHSYNTTWRSKQQGLVGISLNCDWGEPVDISNPKDLEAAERYLQFCLGWFANPIYAGDYPQVMKDYIGRKSAEQGLEMSRLPVFSLQEKSYIKGTSDFLGLGHFTTRYITERNYPSRQGPSYQNDRDLIELVDPNWPDLGSKWLYSVPWGFRRLLNFAQTQYGDPPIYVMENGASQKFHCTQLCDEWRIQYLKGYINEMLKAIKDGANIKGYTSWSLLDKFEWEKGYSDRYGFYYVEFNDRNKPRYPKASVQYYKKIIIANGFPNPREVESWYLKALETCSINNQMLAAEPLLSHMQMVTEIVVPTVCSLCVLITAVLLMLLLRRQS

SEQ ID NO: 10987 - protein, 481 aa, Artificial Sequence
  Description of Artificial Sequence: Synthetic coding sequence
MAASWSLLVTLRPLAQSPLRGRCVGCGAWAAALAPLATAPGKPFWKAYTVQTSESMTPTATSETYLKALAVCHGPLDHYDFLIKAHELKDDEHQRRVIQCLQKLHEDLKGYNIEAEGLFSKLFSRSKPPRGLYVYGDVGTGKTMVMDMFYAYVEMKRKKRVHFHGFMLDVHKRIHRLKQSLPKRKPGFMAKSYDPIAPIAEEISEEACLLCFDEFQVTDIADAMILKQLFENLFKNGVVVVATSNRPPEDLYKNGLQRANFVPFIAVLKEYCNTVQLDSGIDYRKRELPAAGKLYYLTSEADVEAVMDKLFDELAQKQNDLTRPRILKVQGRELRLNKACGTVADCTFEELCERPLGASDYLELSKNFDTIFLRNIPQFTLANRTQGRRFITLIDNFYDLKVRIICSASTPISSLFLHQHHDSELEQSRILMDDLGLSQDSAEGLSMFTGEEEIFAFQRTISRLTEMQTEQYWNEGDRTKK

SEQ ID NO: 10988 - protein, 161 aa, Artificial Sequence
  Description of Artificial Sequence: Synthetic coding sequence
MGCCYSSENEDSDQDREERKLLLDPSSPPTKALNGAEPNYHSLPSARTDEQALLSSILAKTASNIIDVSAADSQGMEQHEYMDRARQYSTRLAVLSSSLTHWKKLPPLPSLTSQPHQVLASEPIPFSDLQQVSRIAAYAYSALSQIRVDAKEELVVQFGIP

SEQ ID NO: 10989 - protein, 150 aa, Artificial Sequence
  Description of Artificial Sequence: Synthetic coding sequence
MLRPKALTQVLSQANTGGVQSTLLLNNEGSLLAYSGYGDTDARVTAAIASNIWAAYDRNGNQAFNEDNLKFILMDCMEGRVAITRVANLLLCMYAKETVGFGMLKAKAVCGTDLCSPSAGPGFGAVPGGAPHPSGGILTALVEAGVRKEK

SEQ ID NO: 10990 - protein, 95 aa, Artificial Sequence
  Description of Artificial Sequence: Synthetic coding sequence
MLRPKALTQVLSQANTGGVQSTLLLNNEGSLLAYSGYGDTDARVTAAIASNIWAAYDRNGNQAFNEDNLKFILMDCMAQALVQYLEEPLTQVAAS

SEQ ID NO: 10991 - protein, 125 aa, Artificial Sequence
  Description of Artificial Sequence: Synthetic coding sequence
MLRPKALTQVLSQANTGGVQSTLLLNNEGSLLAYSGYGDTDARVTAAIASNIWAAYDRNGNQAFNEDNLKFILMDCMEGRVAITRVANLLLCMYAKETVGFGMLKAKAQALVQYLEEPLTQVAAS

SEQ ID NO: 10992 - protein, 124 aa, Artificial Sequence
  Description of Artificial Sequence: Synthetic coding sequence
MADDLKRFLYKKLPSVEGLHAIVVSDRDGVPVIKVANDNAPEHALRPGFLSTFALATDQGSKLGLSKNKSIICYYNTYQVVQFNRLPLVVSFIASSSANTGLIVSLEKELAPLFEELRQVVEVS

SEQ ID NO: 10993 - protein, 1474 aa, Artificial Sequence
  Description of Artificial Sequence: Synthetic coding sequence
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 10994 - protein, 1469 aa, Artificial Sequence
  Description of Artificial Sequence: Synthetic coding sequence
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYIFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 10995 - protein, 1431 aa, Artificial Sequence
  Description of Artificial Sequence: Synthetic coding sequence
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 10996 - protein, 1403 aa, Artificial Sequence
  Description of Artificial Sequence: Synthetic coding sequence
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 10997 - protein, 1416 aa, Artificial Sequence
  Description of Artificial Sequence: Synthetic coding sequence
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 10998 - protein, 1403 aa, Artificial Sequence; identical to SEQ ID NO: 10996
  Description of Artificial Sequence: Synthetic coding sequence

SEQ ID NO: 10999 - protein, 1123 aa, Artificial Sequence
  Description of Artificial Sequence: Synthetic coding sequence
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQDIH

SEQ ID NO: 11000 - protein, 1177 aa, Artificial Sequence
  Description of Artificial Sequence: Synthetic coding sequence
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGLTSHGLRAHLQDLYHLELLLGQIA

SEQ ID NO: 11001 - protein, 1474 aa, Artificial Sequence
  Description of Artificial Sequence: Synthetic coding sequence
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 11002 - protein, 1384 aa, Artificial Sequence
  Description of Artificial Sequence: Synthetic coding sequence
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYMEQKVFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 11003 - protein, 1461 aa, Artificial Sequence
  Description of Artificial Sequence: Synthetic coding sequence
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 11004 - protein, 1474 aa, Artificial Sequence; identical to SEQ ID NO: 11001
  Description of Artificial Sequence: Synthetic coding sequence

SEQ ID NO: 11005 - protein, 1431 aa, Artificial Sequence; identical to SEQ ID NO: 10995
  Description of Artificial Sequence: Synthetic coding sequence

SEQ ID NO: 11006 - protein, 1459 aa, Artificial Sequence
  Description of Artificial Sequence: Synthetic coding sequence
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 11007 - protein, 1416 aa, Artificial Sequence; identical to SEQ ID NO: 10997
  Description of Artificial Sequence: Synthetic coding sequence

SEQ ID NO: 11008 - protein, 1461 aa, Artificial Sequence; identical to SEQ ID NO: 11003
  Description of Artificial Sequence: Synthetic coding sequence

SEQ ID NO: 11009 - protein, 471 aa, Artificial Sequence
  Description of Artificial Sequence: Synthetic coding sequence
  MOD_RES (1)..(1): Any amino acid
XITLCKMVKHSNTLKPDSSRLENINNYRVCDGYYNTDLPGSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPATYRETRHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 11010 - protein, 1351 aa, Artificial Sequence
  Description of Artificial Sequence: Synthetic coding sequence
  MOD_RES (1)..(1): Any amino acid
XFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENINNYRVCDGYYNTDLPGYEDNKPFIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 11011 - protein, 1240 aa, Artificial Sequence
  Description of Artificial Sequence: Synthetic coding sequence
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYRVDQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 11012 - protein, 1447 aa, Artificial Sequence
  Description of Artificial Sequence: Synthetic coding sequence
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYRVDQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 11013 - protein, 918 aa, Artificial Sequence
  Description of Artificial Sequence: Synthetic coding sequence
  MOD_RES (1)..(1): Any amino acid
XYLCLAPDGIWDPQGPDLSNCSSPWVNHITQKLKSGETAANIARELAEQTRNHLNAGDITYSVRAMDQLVGLLDVQLRNLTPGGKDSAARSLNKAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 11014 - protein, 1283 aa, Artificial Sequence
  Description of Artificial Sequence: Synthetic coding sequence
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 11015 - protein, 1231 aa, Artificial Sequence
  Description of Artificial Sequence: Synthetic coding sequence
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 11016 - protein, 1580 aa, Artificial Sequence
  Description of Artificial Sequence: Synthetic coding sequence
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 11017 - protein, 1571 aa, Artificial Sequence
  Description of Artificial Sequence: Synthetic coding sequence
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 11018 - protein, 1342 aa, Artificial Sequence
  Description of Artificial Sequence: Synthetic coding sequence
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 11019 - protein, 1528 aa, Artificial Sequence
  Description of Artificial Sequence: Synthetic coding sequence
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 11020 - protein, 1351 aa, Artificial Sequence
  Description of Artificial Sequence: Synthetic coding sequence
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 11021 - protein, 1512 aa, Artificial Sequence
  Description of Artificial Sequence: Synthetic coding sequence
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 11022 - protein, 1308 aa, Artificial Sequence
  Description of Artificial Sequence: Synthetic coding sequence
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 11023 - protein, 1299 aa, Artificial Sequence
  Description of Artificial Sequence: Synthetic coding sequence
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 11024 - protein, 1240 aa, Artificial Sequence
  Description of Artificial Sequence: Synthetic coding sequence
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 11025 - protein, 1274 aa, Artificial Sequence
  Description of Artificial Sequence: Synthetic coding sequence
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 11026 - protein, 1469 aa, Artificial Sequence
  Description of Artificial Sequence: Synthetic coding sequence
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 11027 - protein, 1503 aa, Artificial Sequence
  Description of Artificial Sequence: Synthetic coding sequence
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 11028 - protein, 707 aa, Artificial Sequence
  Description of Artificial Sequence: Synthetic coding sequence
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYRVDQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKAMVETVNNLLQPQALNAWRDLTTSDQLRAATMLLHTVEESAFVLVLQVCLPVREQSFLPFFSFFIFFFSFLPFIPLKFRLAKNK

SEQ ID NO: 11029 - protein, 1469 aa, Artificial Sequence; identical to SEQ ID NO: 11026
  Description of Artificial Sequence: Synthetic coding sequence

SEQ ID NO: 11030 - protein, 374 aa, Artificial Sequence
  Description of Artificial Sequence: Synthetic coding sequence
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 11031 - protein, 382 aa, Artificial Sequence
  Description of Artificial Sequence: Synthetic coding sequence
MRPGTALQAVLLAVLLVGLRAATGRLLSASDLDLRGGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 11032 - protein, 229 aa, Artificial Sequence
  Description of Artificial Sequence: Synthetic coding sequence
MVTSGLGSGGVRRNKAIAQPARTFMLGLMAAYHNLEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 11033 - protein, 337 aa, Artificial Sequence
  Description of Artificial Sequence: Synthetic coding sequence
MRPGTALQAVLLAVLLVGLRAATGRLLSGQPVCRGGTQRPCYKVIYFHDTSRRLNFEEAKEACRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 11034 - protein, 134 aa, Artificial Sequence
  Description of Artificial Sequence: Synthetic coding sequence
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRETSSSF

SEQ ID NO: 11035 - protein, 356 aa, Artificial Sequence
  Description of Artificial Sequence: Synthetic coding sequence
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKDNVDDPTGNFRSGPLTGWRVFLLLLCALLGIVVCAVVGAVVFQKRQERNKRFY

SEQ ID NO: 11036 - protein, 285 aa, Artificial Sequence
  Description of Artificial Sequence: Synthetic coding sequence
MPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKDNVDDPTGNFRSGPLTGWRVFLLLLCALLGIVVCAVVGAVVFQKRQERNKRFY

SEQ ID NO: 11037 - protein, 348 aa, Artificial Sequence
  Description of Artificial Sequence: Synthetic coding sequence
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 11038 - protein, 359 aa, Artificial Sequence
  Description of Artificial Sequence: Synthetic coding sequence
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQEAQKRRYSPGVQRVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 11039 - protein, 214 aa, Artificial Sequence
  Description of Artificial Sequence: Synthetic coding sequence
MDKERRICMGMAWQSGTQRIGCSQAQKRRYSPGVQRVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 11040 - protein, 203 aa, Artificial Sequence
  Description of Artificial Sequence: Synthetic coding sequence
MDKERRICMGMAWQSGTQRIGCSQRVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 11041 - protein, 210 aa, Artificial Sequence
  Description of Artificial Sequence: Synthetic coding sequence
MQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 11042 - protein, 526 aa, Artificial Sequence
  Description of Artificial Sequence: Synthetic coding sequence
MPAVSGPGPLFCLLLLLLDPHSPETGCPPLRRFEYKLSFKGPRLALPGAGIPFWSHHGDAILGLEEVRLTPSMRNRSGAVWSRASVPFSAWEVEVQMRVTGLGRRGAQGMAVWYTRGRGHVGSVLGGLASWDGIGIFFDSPAEDTQDSPAIRVLASDGHIPSEQPGDGASQGLGSCHWDFRNRPHPFRARITYWGQRLRMSLNSGLTPSDPGEFCVDVGPLLLVPGGFFGVSAATGTLADDHDVLSFLTFSLSEPSPEVPPQPFLEMQQLRLARQLEGLWARLGLGTREDVTPKSDSEAQGEGERLFDLEETLGRHRRILQALRGLSKQLAQAERQWKKQLGPPGQARPDGGWALDASCQIPSTPGRGGHLSMSLNKDSAKVGALLHGQWTLLQALQEMRDAAVRMAAEAQVSYLPVGIEHHFLELDHILGLLQEELRGPAKAAAKAPRPPGQPPRASSCLQPGIFLFYLLIQTVGFFGYVHFRQELNKSLQECLSTGSLPLGPAPHTPRALGILRRQPLPASMPA

SEQ ID NO: 11043 - protein, 514 aa, Artificial Sequence
  Description of Artificial Sequence: Synthetic coding sequence
MPAVSGPGPLFCLLLLLLDPHSPETGCPPLRRFEYKLSFKGPRLALPGAGIPFWSHHGDAILGLEEVRLTPSMRNRSGAVWSRASVPFSAWEVEVQMRVTGLGRRGAQGMAVWYTRGRGHVGSVLGGLASWDGIGIFFDSPAEDTQDSPAIRVLASDGHIPSEQPGDGASQGLGSCHWDFRNRPHPFRARITYWGQRLRMSLNSGLTPSDPGEFCVDVGPLLLVPGGFFGVSAATGTLAGEDPTGQVPPQPFLEMQQLRLARQLEGLWARLGLGTREDVTPKSDSEAQGEGERLFDLEETLGRHRRILQALRGLSKQLAQAERQWKKQLGPPGQARPDGGWALDASCQIPSTPGRGGHLSMSLNKDSAKVGALLHGQWTLLQALQEMRDAAVRMAAEAQVSYLPVGIEHHFLELDHILGLLQEELRGPAKAAAKAPRPPGQPPRASSCLQPGIFLFYLLIQTVGFFGYVHFRQELNKSLQECLSTGSLPLGPAPHTPRALGILRRQPLPASMPA

SEQ ID NO: 11044 - protein, 144 aa, Artificial Sequence
  Description of Artificial Sequence: Synthetic coding sequence
MRNRSGAVWSRASVPFSAWEVEVQMRVTGLGRRGAQGMDSPAIRVLASDGHIPSEQPGDGASQGLGSCHWDFRNRPHPFRARITYWGQRLRMSLNSGLTPSDPGEFCVDVGPLLLVPGGFFGVSAATGTLAGEDPTGQVRAEGQ

SEQ ID NO: 11045 - protein, 67 aa, Artificial Sequence
  Description of Artificial Sequence: Synthetic coding sequence
MVDVKCLSDCKLQNQLEKLGFSPGPILRGLQEHQAPESHMGLSPKRETTARKTRLSRAGEKKVSQWA

SEQ ID NO: 11046 - protein, 140 aa, Artificial Sequence
  Description of Artificial Sequence: Synthetic coding sequence
MVDVKCLSDCKLQNQLEKLGFSPGPILQLNIILQGNIILSTEKSKKLKKWPEASTTKRKAVDTYCLDYKPSKGRRWAARAPSTRITYGTITKERDYCAEDQTIESWREEGFPVGLKLAVLGIFIIVVFVYLTVENKSLFG

SEQ ID NO: 11047 - protein, 140 aa, Artificial Sequence; identical to SEQ ID NO: 11046
  Description of Artificial Sequence: Synthetic coding sequence

SEQ ID NO: 11048 - protein, 181 aa, Artificial Sequence
  Description of Artificial Sequence: Synthetic coding sequence
MVDVKCLSDCKLQNQLEKLGFSPGPILPSTRKLYEKKLVQLLVSPPCAPPVMNGPRELDGAQDSDDSEELNIILQGNIILSTEKSKKLKKWPEASTTKRKAVDTYCLDYKPSKGRRWAARAPSTRITYGTITKERDYCAEDQTIESWREEGFPVGLKLAVLGIFIIVVFVYLTVENKSLFG

SEQ ID NO: 11049 - protein, 108 aa, Artificial Sequence
  Description of Artificial Sequence: Synthetic coding sequence
MVDVKCLSDCKLQNQLEKLGFSPGPILPSTRKLYEKKLVQLLVSPPCAPPVMNGPRELDGAQDSDDSEGGLQEHQAPESHMGLSPKRETTARKTRLSRAGEKKVSQWA

SEQ ID NO: 11050 - protein, 108 aa, Artificial Sequence; identical to SEQ ID NO: 11049
  Description of Artificial Sequence: Synthetic coding sequence

SEQ ID NO: 11051 - protein, 503 aa, Artificial Sequence
  Description of Artificial Sequence: Synthetic coding sequence
MAGLSDLELRRELQALGFQPGPITDTTRDVYRNKLRRLRGEARLRDEERLREEARPRGEERLREEARLREDAPLRARPAAASPRAEPWLSQPASGSAYATPGAYGDIRPSAASWVGSRGLAYPARPAQLRRRASVRGSSEEDEDARTPDRATQGPGLAARRWWAASPAPARLPSSLLGPDPRPGLRATRAGPAGAARARPEVGRRLERWLSRLLLWASLGLLLVFLGILWVKMGKPSAPQEAEDNMKLLPVDCERKTDEFCQAKQKAALLELLHELYNFLAIQAGNFECGNPENLKSKCIPVMEAQEYIANVTSSSSAKFEAALTWILSSNKDVGIWLKGEDQSELVTTVDKVVCLESAHPRMGVGCRLSRALLTAVTNVLIFFWCLAFLWGLLILLKYRWRKLEEEEQAMYEMVKKIIDVVQDHYVDWEQDMERYPYVGILHVRDSLIPPQSRRRMKRVWDRAVEFLASNESRIQTESHRVAGEDMLVWRWTKPSSFSDSER

SEQ ID NO: 11052 - protein, 201 aa, Artificial Sequence
  Description of Artificial Sequence: Synthetic coding sequence
MEAQEYIANVTSSSSAKFEAALTWILSSNKDVGIWLKGEDQSELVTTVDKVVCLESAHPRMGVGCRLSRALLTAVTNVLIFFWCLAFLWGLLILLKYRWRKLEEEEQAMYEMVKKIIDVVQDHYVDWEQDMERYPYVGILHVRDSLIPPQSRRRMKRVWDRAVEFLASNESRIQTESHRVAGEDMLVWRWTKPSSFSDSER

SEQ ID NO: 11053 - protein, 54 aa, Artificial Sequence
  Description of Artificial Sequence: Synthetic coding sequence
MEAQEYIANVTSSSSAKFEAALTWILSSNKDVGIWLKGEDQSELVTTVDKVVCL

SEQ ID NO: 11054 - protein, 1489 aa, Artificial Sequence
  Description of Artificial Sequence: Synthetic coding sequence
MRQVLWLCNVCVTARETRHHLHLPAILDKMPAPGALILLAAVSASGCLASPAHPDGFALGRAPLAPPYAVVLISCSGLLAFIFLLLTCLCCKRGDVGFKEFENPEGEDCSGEYTPPAEETSSSQSLPDVYILPLAEVSLPMPAPQPSHSDMTTPLGLSRQHLSYLQEIGSGWFGKVILGEIFSDYTPAQVVVKELRASAGPLEQRKFISEAQPYRSLQHPNVLQCLGLCVETLPFLLIMEFCQLGDLKRYLRAQRPPEGLSPELPPRDLRTLQRMGLEIARGLAHLHSHNYVHSDLALRNCLLTSDLTVRIGDYGLAHSNYKEDYYLTPERLWIPLRWAAPELLGELHGTFMVVDQSRESNIWSLGVTLWELFEFGAQPYRHLSDEEVLAFVVRQQHVKLARPRLKLPYADYWYDILQSCWRPPAQRPSASDLQLQLTYLLSERPPRPPPPPPPPRDGPFPWPWPPAHSAPRPGTLSSPFPLLDGFPGADPDDVLTVTESSRGLNLECLWEKARRGAGRGGGAPAWQPASAPPAPHANPSNPFYEALSTPSVLPVISARSPSVSSEYYIRLEEHGSPPEPLFPNDWDPLDPGVPAPQAPQAPSEVPQLVSETWASPLFPAPRPFPAQSSASGSFLLSGWDPEGRGAGETLAGDPAEVLGERGTAPWVEEEEEEEEGSSPGEDSSSLGGGPSRRGPLPCPLCSREGACSCLPLERGDAVAGWGGHPALGCPHPPEDDSSLRAERGSLADLPMAPPASAPPEFLDPLMGAAAPQYPGRGPPPAPPPPPPPPRAPADPAASPDPPSAVASPGSGLSSPGPKPGDSGYETETPFSPEGAFPGGGAAEEEGVPRPRAPPEPPDPGAPRPPPDPGPLPLPGPREKPTFVVQVSTEQLLMSLREDVTRNLLGEKGATARETGPRKAGRGPGNREKVPGLNRDPTVLGNGKQAPSLSLPVNGVTVLENGDQRAPGIEEKAAENGALGSPEREEKVLENGELTPPRREEKALENGELRSPEAGEKVLVNGGLTPPKSEDKVSENGGLRFPRNTERPPETGPWRAPGPWEKTPESWGPAPTIGEPAPETSLERAPAPSAVVSSRNGGETAPGPLGPAPKNGTLEPGTERRAPETGGAPRAPGAGRLDLGSGGRAPVGTGTAPGGGPGSGVDAKAGWVDNTRPQPPPPPLPPPPEAQPRRLEPAPPRARPEVAPEGEPGAPDSRAGGDTALSGDGDPPKPERKGPEMPRLFLDLGPPQGNSEQIKARLSRLSLALPPLTLTPFPGPGPRRPPWEGADAGAAGGEAGGAGAPGPAEEDGEDEDEDEEEDEEAAAPGAAAGPRGPGRARAAPVPVVVSSADADAARPLRGLLKSPRGADEPEDSELERKRKMVSFHGDVTVYLFDQETPTNELSVQAPPEGDTDPSTPPAPPTPPHPATPGDGFPSNDSGFGGSFEWAEDFPLLPPPGPPLCFSRFSVSPALETPGPPARAPDARPAGPVEN

SEQ ID NO: 11055 - protein, 551 aa, Artificial Sequence
  Description of Artificial Sequence: Synthetic coding sequence
MHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 11056 - protein, 735 aa, Artificial Sequence
  Description of Artificial Sequence: Synthetic coding sequence
MLRLLRPLLLLLLLPPPGSPEPPGLTQLSPGAPPQAPDLLYADGLRAYAAGAWAPAVALLREALRSQAALGRVRLDCGASCAADPGAALPAVLLGAPEPDSGPGPTQGSWERQLLRAALRRADCLTQCAARRLGPGGAARRVGSALRDAFRRREPYNYLQRAYYQLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 11057 - protein, 163 aa, Artificial Sequence
  Description of Artificial Sequence: Synthetic coding sequence
MLRLLRPLLLLLLLPPPGSPEPPGLTQLSPGAPPQAPDLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 11058 - protein, 360 aa, Artificial Sequence
  Description of Artificial Sequence: Synthetic coding sequence
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 11059 - protein, 99 aa, Artificial Sequence
  Description of Artificial Sequence: Synthetic coding sequence
MALSRVCWARSAVWGSAVTPGHFVTRRLQLGRSGLAWGAPRSSKLHLSPKADVKNLMSYVVTKTKAINGKYHRFLGRHFPRFYVLYTIFMKGTCFPGNY

SEQ ID NO: 11060 - protein, 273 aa, Artificial Sequence
  Description of Artificial Sequence: Synthetic coding sequence
MALSRVCWARSAVWGSAVTPGHFVTRRLQLGRSGLAWGAPRSSKLHLSPKADVKNLMSYVVTKTKAINGKYHRFLGRHFPRFYVLYTIFMKGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTALHQLPWDKALNEPWSGWHCPAVV

SEQ ID NO: 11061 - protein, 304 aa, Artificial Sequence
  Description of Artificial Sequence: Synthetic coding sequence
MSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 11062 - protein, 373 aa, Artificial Sequence
  Description of Artificial Sequence: Synthetic coding sequence
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQVWARGRYPEVHGEFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 11063 - protein, 593 aa, Artificial Sequence
  Description of Artificial Sequence: Synthetic coding sequence
MDAATAPKQAWPPWPPLLFLLLLPGGSGGSCPAVCDCTSQPQAVLCGHRQLEAVPGGLPLDTELLDLSGNRLWGLQQGMLSRLSLLQELDLSYNQLSTLEPGAFHGLQSLLTLRLQGNRLRIMGPGVFSGLSALTLLDLRLNQIVLFLDGAFGELGSLQKLEVGDNHLVFVAPGAFAGLAKLSTLTLERCNLSTVPGLALARLPALVALRLRELDIGRLPAGALRGLGQLKELEIHLWPSLEALDPGSLVGLNLSSLAITRCNLSSVPFQALYHLSFLRVLDLSQNPISAIPARRLSPLVRLQELRLSGACLTSIAAHAFHGLTAFHLLDVADNALQTLEETAFPSPDKLVTLRLSGNPLTCDCRLLWLLRLRRHLDFGMSPPACAGPHHVQGKSLKEFSDILPPGHFTCKPALIRKSGPRWVIAEEGGHAVFSCSGDGDPAPTVSWMRPHGAWLGRAGRVRVLEDGTLEIRSVQLRDRGAYVCVVSNVAGNDSLRTWLEVIQVEPPNGTLSDPNITVPGIPGPFFLDSRGVAMVLAVGFLPFLTSVTLCFGLIALWSKGKGRVKHHMTFDFVAPRPSGDKNSGGNRVTAKLF

SEQ ID NO: 11064 - protein, 581 aa, Artificial Sequence
  Description of Artificial Sequence: Synthetic coding sequence
MPLKHYLLLLVGCQAWGAGLAYHGCPSECTCSRASQVECTGARIVAVPTPLPWNAMSLQILNTHITELNESPFLNISALIALRIEKNELSRITPGAFRNLGSLRYLSLANNKLQVLPIGLFQGLDSLESLLLSSNQLLQIQPAHFSQCSNLKELQLHGNHLEYIPDGAFDHLVGLTKLNLGKNSLTHISPRVFQHLGNLQVLRLYENRLTDIPMGTFDGLVNLQELALQQNQIGLLSPGLFHNNHNLQRLYLSNNHISQLPPSVFMQLPQLNRLTLFGNSLKELSPGIFGPMPNLRELWLYDNHISSLPDNVFSNLRQLQVLILSRNQISFISPGAFNGLTELRELSLHTNALQDLDGNVFRMLANLQNISLQNNRLRQLPGNIFANVNGLMAIQLQNNQLENLPLGIFDHLGKLCELRLYDNPWRCDSDILPLRNWLLLNQPRLGTDTVPVCFSPANVRGQSLIIINVNVAVPSVHVPEVPSYPETPWYPDTPSYPDTTSVSSTTELTSPVEDYTDLTTIQVTDDRSVWGMTQAQSGLAIAAIVIGIVALACSLAACVGCCCCKKRSQAVLMQMKAPNEC

SEQ ID NO: 11065 - protein, 587 aa, Artificial Sequence
  Description of Artificial Sequence: Synthetic coding sequence
MPLDKAMPLKHYLLLLVGCQAWGAGLAYHGCPSECTCSRASQVECTGARIVAVPTPLPWNAMSLQILNTHITELNESPFLNISALIALRIEKNELSRITPGAFRNLGSLRYLSLANNKLQVLPIGLFQGLDSLESLLLSSNQLLQIQPAHFSQCSNLKELQLHGNHLEYIPDGAFDHLVGLTKLNLGKNSLTHISPRVFQHLGNLQVLRLYENRLTDIPMGTFDGLVNLQELALQQNQIGLLSPGLFHNNHNLQRLYLSNNHISQLPPSVFMQLPQLNRLTLFGNSLKELSPGIFGPMPNLRELWLYDNHISSLPDNVFSNLRQLQVLILSRNQISFISPGAFNGLTELRELSLHTNALQDLDGNVFRMLANLQNISLQNNRLRQLPGNIFANVNGLMAIQLQNNQLENLPLGIFDHLGKLCELRLYDNPWRCDSDILPLRNWLLLNQPRLGTDTVPVCFSPANVRGQSLIIINVNVAVPSVHVPEVPSYPETPWYPDTPSYPDTTSVSSTTELTSPVEDYTDLTTIQVTDDRSVWGMTQAQSGLAIAAIVIGIVALACSLAACVGCCCCKKRSQAVLMQMKAPNEC

SEQ ID NO: 11066 - protein, 587 aa, Artificial Sequence; identical to SEQ ID NO: 11065
  Description of Artificial Sequence: Synthetic coding sequence

SEQ ID NO: 11067 - protein, 370 aa, Artificial Sequence
  Description of Artificial Sequence: Synthetic coding sequence
MKVTGITILFWPLSMILLSDKIQSSKREVQCNFTEKNYTLIPADIKKDVTILDLSYNQITLNGTDTRVLQTYFLLTELYLIENKVTILHNNGFGNLSSLEILNICRNSIYVIQQGAFLGLNKLKQLYLCQNKIEQLNADVFVPLRSLKLLNLQGNLISYLDVPPLFHLELITLYGNLWNCSCSLFNLQNWLNTSNVTLENENITMCSYPNSLQSYNIKTVPHKAECHSKFPSSVTEDLYIHFQPISNSIFNSSSNNLTRNSEHEPLGKSWAFLVGVVVTVLTTSLLIFIAIKCPIWYNILLSYNHHRLEEHEAETYEDGFTGNPSSLSQIPETNSEETTVIFEQLHSFVVDDDGFIEDKYIDIHELCEEN

SEQ ID NO: 11068 - protein, 513 aa, Artificial Sequence
  Description of Artificial Sequence: Synthetic coding sequence
MALRAPALLPLLLLLLPLRAAGCPAACRCYSATVECGALRLRVVPLGIPPGTQTLFLQDNNIARLEPGALAPLAALRRLYLHNNSLRALEAGAFRAQPRLLELALTSNRLRGLRSGAFVGLAQLRVLYLAGNQLARLLDFTFLHLPRLQELHLQENSIELLEDQALAGLSSLALLDLSRNQLGTISREALQPLASLQVLRLTENPWRCDCALHWLGAWIKEGGQRLLTSRDRKIMCAEPPRLALQSLLDVSHSSLICIPPSVHVQPLELTANLGEDLRVACQASGYPQPLVTWRKVPQPREGRPRAQAQLEGGLLGLGGHSASDTGSGMLFLSNITLAHAGKYECEASNAGGAARVPFRLLVNASRQQPQQPAQPPPPAARPAGSEPRPEAGSMAFRALGVATQTAIAAAIALLALTALLLVAMICRRRRRRKKARGPPGEGALFVNDYLDGPCTFAQLEELRDERGHEMFVINRSKPLFAEGPAEAPADCGPEQGAGPGLRVPPPVAYEIHC

SEQ ID NO: 11069 - protein, 257 aa, Artificial Sequence
  Description of Artificial Sequence: Synthetic coding sequence
MGTVRPPRPSLLLVSTRESCLFLLFCLHLGAACPQPCRCPDHAGAVAVFCSLRGLQEVPEDIPANTVLLKLDANKISHLPDGAFQHLHRLRELDLSHNAIEAIGSATFAGLAGGLRLLDLSYNRIQRIPKDALGKLSAKIRLSHNPLHCECALQEALWELKLDPDSVDEIACHTSVQEEFVGKPLVQALDAGASLCSVPHRTTDVAMLVTMFGWFAMVIAYVVYYVRHNQEDARRHLEYLKSLPSAPASKDPIGPGP

SEQ ID NO: 11070 - protein, 137 aa, Artificial Sequence
  Description of Artificial Sequence: Synthetic coding sequence
MGTVRPPRPSLLLVSTRESCLFLLFCLHLGAACPQPCRCPDHAGAVAVFCSLRGLQEVPEDIPANTVLLKLDANKISHLPDGAFQHLHRLRELDLSHNAIEAIGSATFAGLAGGLRLLDLSYNRIQRIPKDPIGPGP

SEQ ID NO: 11071 - protein, 662 aa, Artificial Sequence
  Description of Artificial Sequence: Synthetic coding sequence
MRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNINLIIILTFILVSAILLTTLAACCCVRRQKFNQQYKA

SEQ ID NO: 11072 - protein, 662 aa, Artificial Sequence; identical to SEQ ID NO: 11071
  Description of Artificial Sequence: Synthetic coding sequence

SEQ ID NO: 11073 - protein, 662 aa, Artificial Sequence; identical to SEQ ID NO: 11071
  Description of Artificial Sequence: Synthetic coding sequence

SEQ ID NO: 11074 - protein, 186 aa, Artificial Sequence
  Description of Artificial Sequence: Synthetic coding sequence
MRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLM

SEQ ID NO: 11075 - protein, 692 aa, Artificial Sequence
  Description of Artificial Sequence: Synthetic coding sequence
MELLPLWLCLGFHFLTVGWRNRSGTATAASQGVCKLVGGAADCRGQSLASVPSSLPPHARMLTLDANPLKTLWNHSLQPYPLLESLSLHSCHLERISRGAFQEQGHLRSLVLGDNCLSENYEETAAALHALPGLRRLDLSGNALTEDMAALMLQNLSSLRSVSLAGNTIMRLDDSVFEGLERLRELDLQRNYIFEIEGGAFDGLAELRHLNLAFNNLPCIVDFGLTRLRVLNVSYNVLEWFLATGGEAAFELETLDLSHNQLLFFPLLPQYSKLRTLLLRDNNMGFYRDLYNTSSPREMVAQFLLVDGNVTNITTVSLWEEFSSSDLADLRFLDMSQNQFQYLPDGFLRKMPSLSHLNLHQNCLMTLHIREHEPPGALTELDLSHNQLSELHLAPGLASCLGSLRLFNLSSNQLLGVPPGLFANARNITTLDMSHNQISLCPLPAASDRVGPPSCVDFRNMASLRSLSLEGCGLGALPDCPFQGTSLTYLDLSSNWGVLNGSLAPLQDVAPMLQVLSLRNMGLHSSFMALDFSGFGNLRDLDLSGNCLTTFPRFGGSLALETLDLRRNSLTALPQKAVSEQLSRGLRTIYLSQNPYDCCGVDGWGALQHGQTVADWAMVTCNLSSKIIRVTELPGGVPRDCKWERLDLGLLYLVLILPSCLTLLVACTVIVLTFKKPLLQVIKSRCHWSSVY

SEQ ID NO: 11076 - protein, 1634 aa, Artificial Sequence
  Description of Artificial Sequence: Synthetic coding sequence
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIHQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESSREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQLPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLIVPSHMACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKKLILALIVTGILTILIILLCLIEICCHRRSLQEDEEGFSRDSEAPTEEESEALP

SEQ ID NO: 11077 - protein, 1634 aa, Artificial Sequence; identical to SEQ ID NO: 11076
  Description of Artificial Sequence: Synthetic coding sequence

SEQ ID NO: 11078 - protein, 611 aa, Artificial Sequence
  Description of Artificial Sequence: Synthetic coding sequence
MACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKKLILALIVTGILTILIILLCLIEICCHRRSLQEDEEGFSRDSEAPTEEESEALP

SEQ ID NO: 11079 - protein, 715 aa, Artificial Sequence
  Description of Artificial Sequence: Synthetic coding sequence
HRNFQGNYISYIDGNVWKAYSWTEKLILRENNLTELHKDSFEGLLSLQYLILNHNPLTTVEDPYLFKLPALKYLDMGTTLVPLTTLKNILMMTVELEKLIVPSHMACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKKLILALIVTGILTILIILLCLIEICCHRRSLQEDEEGFSRDSEAPTEEESEALP

SEQ ID NO: 11080 - protein, 672 aa, Artificial Sequence
  Description of Artificial Sequence: Synthetic coding sequence
MQFLHKLILNHNPLTTVEDPYLFKLPALKYLDMGTTLVPLTTLKNILMMTVELEKLIVPSHMACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKKLILALIVTGILTILIILLCLIEICCHRRSLQEDEEGFSRDSEAPTEEESEALP

SEQ ID NO: 11081 - protein, 1700 aa, Artificial Sequence
  Description of Artificial Sequence: Synthetic coding sequence
MSSAQCPALVCVMSRLRFWGPWPLLMWQLLWLLVKEAQPLEWVKDPLQLTSNPLGPPESWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLTSPAPREVEQPHTQQGPEKLAGNAVYTKPSFTQEHKAAVSVLKPFSKGTPSTSSPAKALPQVRDRSKDLTHAISILESAKARVTNTKTSKPIVHARKKYRFHKTRSHVTHRTTKVKKSPKVRKKSYLSRLMLANRLPFSAAKSLINSPSQGAFSSLGDLSPQENPFLEVSALSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPWRGCSSRRESQDGLSSFGQPLWFKDLYKPLSATRINNHAWKLHKKSSNEDKILNRDPGDSEAPTEEEESEALP

SEQ ID NO: 11082 - protein, 1700 aa, Artificial Sequence; identical to SEQ ID NO: 11081
  Description of Artificial Sequence: Synthetic coding sequence

SEQ ID NO: 11083 - protein, 974 aa, Artificial Sequence
  Description of Artificial Sequence: Synthetic coding sequence
MAHAYKGHEHLRAARMAFAECIAPACVMSWLRFWGPWPLLTWQLLSLLVKEAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 11084 - protein, 947 aa, Artificial Sequence
  Description of Artificial Sequence: Synthetic coding sequence
MSWLRFWGPWPLLTWQLLSLLVKEAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 11085 - protein, 896 aa, Artificial Sequence
  Description of Artificial Sequence: Synthetic coding sequence
MSWLRFWGPWPLLTWQLLSLLVKEAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 11086 - protein, 865 aa, Artificial Sequence
  Description of Artificial Sequence: Synthetic coding sequence
MSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 11087 - protein, 294 aa, Artificial Sequence
  Description of Artificial Sequence: Synthetic coding sequence
MRPRAPACAAAALGLCSLLLLLAPGHACPAGCACTDPHTVDCRDRGLPSVPDPFPLDVRKLLVAGNRIQRIPEDFFIFYGDLVYLDFRNNSLRSLEEGTFSGSAKLVFLDLSYNNLTQLGAGAFRSAGRLVKLSLANNNLVGVHEDAFETLESLQVLELNDNNLRSLSVAALAALPALRSLRLDGNPWLCDCDFAHLFSWIQENASKLPKGLDEIQCSLPMESRRISLRELSEASFSECRFSLSLTDLCIIIFSGVAVSIAAIISSFFLATVVQCLQRCAPNKDAEDEDEDKDD

SEQ ID NO: 11088 - protein, 259 aa, Artificial Sequence
  Description of Artificial Sequence: Synthetic coding sequence
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASNHETAHNVICKTSVLDEHAGRPFLNAANDADLCNLPKKTTDYAMLVTMFGWFTMVISYVVYYVRQNQEDARRHLEYLKSLPSRQKKADEPDDISTVV

SEQ ID NO: 11089 - protein, 55 aa, Artificial Sequence
  Description of Artificial Sequence: Synthetic coding sequence
MNLVDLWLTRSLSMCLLLQSFVLMILCFHSASMCPKGCLCSSSGGLNVTCSNANL

SEQ ID NO: 11090 - protein, 259 aa, Artificial Sequence; identical to SEQ ID NO: 11088
  Description of Artificial Sequence: Synthetic coding sequence

SEQ ID NO: 11091 - protein, 163 aa, Artificial Sequence
  Description of Artificial Sequence: Synthetic coding sequence
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASN

SEQ ID NO: 11092 - protein, 259 aa, Artificial Sequence; identical to SEQ ID NO: 11088
  Description of Artificial Sequence: Synthetic coding sequence

SEQ ID NO: 11093 - protein, 275 aa, Artificial Sequence
  Description of Artificial Sequence: Synthetic coding sequence
MRMTSSSFVSYCTPGLCQFMAMLPTAGHLLPLLLVIGTGGTVPSPQVPPRGCYVAKEAGERTFRCSQAGLSAVPSGIPNDTRKLYLDANQLASVPAGAFQHLPVLEELDLSHNALAHLSGAAFQGLEGTLRHLDLSANQLASVPVEAFVGLQIQVNLSANPWHCDCALQEVLRQVRLVPGTGTGIVCGSGARPDLVGQEFLLLAGEEELCGSGWGGARRSTDVALLVTMGGWLTLMVAYLVHYVWQNRDETRRSLKRAPVLPVRSEDSSILSTVV

SEQ ID NO: 11094 - protein, 653 aa, Artificial Sequence
  Description of Artificial Sequence: Synthetic coding sequence
MKLLWQVTVHHHTWNAILLPFVYLTAQVWILCAAIAAAASAGPQNCPSVCSCSNQFSKVVCTRRGLSEVPQGIPSNTRYLNLMENNIQMIQADTFRHLHHLEVLQLGRNSIRQIEVGAFNGLASLNTLELFDNWLTVIPSGAFEYLSKLRELWLRNNPIESIPSYAFNRVPSLMRLDLGELKKLEYISEGAFEGLFNLKYLNLGMCNIKDMPNLTPLVGLEELEMSGNHFPEIRPGSFHGLSSLKKLWVMNSQVSLIERNAFDGLASLVELNLAHNNLSSLPHDLFTPLRYLVELHLHHNPWNCDCDILWLAWWLREYIPTNSTCCGRCHAPMHMRGRYLVEVDQASFQCSAPFIMDAPRDLNISEGRMAELKCRTPPMSSVKWLLPNGTVLSHASRHPRISVLNDGTLNFSHVLLSDTGVYTCMVTNVAGNSNASAYLNVSTAELNTSNYSFFTTVTVETTEISPEDTTRKYKPVPTTSTGYQPAYTTSTTVLIQTTRVPKQVAVPATDTTDKMQTSLDEVMKTTKIIIGCFVAVTLLAAAMLIVFYKLRKRHQQRSTVTAARTVEIIQVDEDIPAATSAAATAAPSGVSGEGAVVLPTIHDHINYNTYKPAHGAHWTENSLGNSLHPTVTTISEPYIIQTHTKDKVQETQI

SEQ ID NO: 11095 - protein, 94 aa, Artificial Sequence
  Description of Artificial Sequence: Synthetic coding sequence
MKLLWQVTVHHHTWNAILLPFVYLTAQVWILCAAIAAAASAGPQNCPSVCSCSNQFSKVVCTRRGLSEVPQGIPSNTRYLNLMENNIQMIQADT

SEQ ID NO: 11096 - protein, 51 aa, Artificial Sequence
  Description of Artificial Sequence: Synthetic coding sequence
MKLLWQVTVHHHTWNAILLPFVYLTAQVWILCAAIAAAASAGPQNCPSVCS

SEQ ID NO: 11097 - protein, 713 aa, Artificial Sequence
  Description of Artificial Sequence: Synthetic coding sequence
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWLTPNGTLMTHGSYRVRISVLHDGTLNFTNVTVQDTGQYTCMVTNSAGNTTASATLNVSAVDPVAAGGTGSGGGGPGGSGGVGGGSGGYTYFTTVTVETLETQPGEEALQPRGTEKEPPGPTTDGVWGGGRPGDAAGPASSSTTAPAPRSSRPTEKAFTVPITDVTENALKDLDDVMKTTKIIIGCFVAITFMAAVMLVAFYKLRKQHQLHKHHGPTRTVEIINVEDELPAASAVSVAAAAAVASGGGVGGDSHLALPALERDHLNHHHYVAAAFKAHYSSNPSGGGCGGKGPPGLNSIHEPLLFKSGSKENVQETQI

SEQ ID NO: 11098 - protein, 421 aa, Artificial Sequence
  Description of Artificial Sequence: Synthetic coding sequence
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWWPQLHPRTSALQERLQGERARDADL

SEQ ID NO: 11099 - protein, 313 aa, Artificial Sequence
  Description of Artificial Sequence: Synthetic coding sequence
MSLASGPGPGWLLFSFGMGLVSGSKCPNNCLCQAQEVICTGKQLTEYPLDIPLNTRRLFLNENRITSLPAMHLGLLSDLVYLDCQNNRIREVMDYTFIGVFKLIYLDLSSNNLTSISPFTFSVLSNLVQLNIANNPHLLSLHKFTFANTTSLRYLDLRNTGLQTLDSAALYHLTTLETLFLSGNPWKCNCSFLDFAIFLIVFHMDPSDDLNATCVEPTELTGWPITRVGNPLRYMCITHLDHKDYIFLLLIGFCIFAAGTVAAWLTGVCAVLYQNTRHKSSEEDEDEAGTRVEVSRRIFQTQTSSVQEFPQLI

SEQ ID NO: 11100 - protein, 341 aa, Artificial Sequence
  Description of Artificial Sequence: Synthetic coding sequence
MLRSPTFTDAGPRCSCLPVSQTLDSMDTVLMGSLQHCCCLLPKMGDTWAQLPWPGPPHPAMLLISLLLAAGLMHSDAGTSCPVLCTCRNQVVDCSSQRLFSVPPDLPMDTRNLSLAHNRITAVPPGYLTCYMELQVLDLHNNSLMELPRGLFLHAKRLAHLDLSYNNFSHVPADMFQEAHGLVHIDLSHNPWLRRVHPQAFQGLMQLRDLDLSYGGLAFLSLEALEGLPGLVTLQIGGNPWVCGCTMEPLLKWLRNRIQRCTADSQLAECRGPPEVEGAPLFSLTEESFKACHLTLTLDDYLFIAFVGFVVSIASVATNFLLGITANCCHRWSKASEEEEI

SEQ ID NO: 11101 - protein, 307 aa, Artificial Sequence
  Description of Artificial Sequence: Synthetic coding sequence
MTKAGSKGGNLRDKLDGNELDLSLSDLNEVPVKELAALPKATILDLSCNKLTTLPSDFCGLTHLVKLDLSKNKLQQLPADFGRLVNLQHLDLLNNKLVTLPVSFAQLKNLKWLDLKDNPLDPVLAKVAGDCLDEKQCKQCANKVLQHMKAVQADQERERQRRLEVEREAEKKREAKQRAKEAQERELRKREKAEEKERRRKEYDALKAAKREQEKKPKKEANQAPKSKSGSRPRKPPPRKHTRSWAVLKLLLLLLLFGVAGGLVACRVTELQQQPLCTSVNTIYDNAVQGLRRHEILQWVLQTDSQQ

SEQ ID NO: 11102 - protein, 880 aa, Artificial Sequence
  Description of Artificial Sequence: Synthetic coding sequence
MKNLYFRVITIVIGLYFTGIMTNASRKSNILFNSECQWNEYILTNCSFTGKCDIPVDISQTAATVDVSFNFFRVLLQSHTKKEEWKIKHLDLSNNLISKITLSPFAYLHALEVLNLSNNAIHSLSLDLLSPKSSWVKRHRSSFRNRFPLLKVLILQRNKLSDTPKGLWKLKSLQSLDLSFNGILQIGWSDFHNCLQLENLCLKSNKIFKIPPQAFKDLKKLQVIDLSNNALITILPMMIIALEFPHLVVDLADNNWQCDDSVAVFQNFISESWRKKWNVICNRSIGSEEANGGTPQSRISRETRLPPIHLHRMKSLIRSKAERPQGGRHTGISTLGKKAKAGSGLRKKQRRLPRSVRSTRDVQAAGKKEDAPQDLALAVCLSVFITFLVAFSLGAFTRPYVDRLWQKKCQSKSPGLDNAYSNEGFYDDMEAAGHTPHPETHLRQVFPHLSLYENQTPFWVTQPHPHATVIPDRTLGRSRKDPGSSQSPGQCGDNTGAGSGNDGAVYSILQRHPHAGNRELMSAAQDHIHRNDILGEWTYETVAQEEPLSAHSVGVSSVAGTSHAVSGSSRYDSNELDPSLSGEITASLCKMLTHAEAQRTGDSKERGGTEQSLWDSQMEFSKERQVSSSIDLLSIQQPRLSGARAEEALSAHYSEVPYGDPRDTGPSVFPPRWDSGLDVTPANKEPVQKSTPSDTCCELESDCDSDEGSLFTLSSISSESARSKTEEAVPDEESLQDESSGASKDNVTAVDSLEENVTFQTIPGKCKNQEDPFEKPLISAPDSGMYKTHLENASDTDRSEGLSPWPRSPGNSPLGDEFPGMFTYDYDTALQSKAAEWHCSLRDLEFSNVDVLQQTPPCSAEVPSDPDKAAFHERDSDILK

SEQ ID NO: 11103 - protein, 622 aa, Artificial Sequence
  Description of Artificial Sequence: Synthetic coding sequence
MCGLQFSLPCLRLFLVVTCYLLLLLHKEILGCSSVCQLCTGRQINCRNLGLSSIPKNFPESTVFLYLTGNNISYINESELTGLHSLVALYLDNSNILYVYPKAFVQLRHLYFLFLNNNFIKRLDPGIFKGLLNLRNLYLQYNQVSFVPRGVFNDLVSVQYLNLQRNRLTVLGSGTFVGMVALRILDLSNNNILRISESGFQHLENLACLYLGSNNLTKVPSNAFEVLKSLRRLSLSHNPIEAIQPFAFKGLANLEYLLLKNSRIRNVTRDGFSGINNLKHLILSHNDLENLNSDTFSLLKNLIYLKLDRNRIISIDNDTFENMGASLKILNLSFNNLTALHPRVLKPLSSLIHLQANSNPWECNCKLLGLRDWLASSAITLNIYCQNPPSMRGRALRYINITNCVTSSINVSRAWAVVKSPHIHHKTTALMMAWHKVTTNGSPLENTETENITFWERIPTSPAGRFFQENAFGNPLETTAVLPVQIQLTTSVTLNLEKNSALPNDAASMSGKTSLICTQEVEKLNEAFDILLAFFILACVLIIFLIYKVVQFKQKLKASENSRENRLEYYSFYQSARYNVTASICNTSPNSLESPGLEQIRLHKQIVPENEAQVILFEHSAL

SEQ ID NO: 11104 - protein, 716 aa, Artificial Sequence
  Description of Artificial Sequence: Synthetic coding sequence
MARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTALAAVMGSMFAVISLASIAVYFAKRFKRKNYHHSLKKYMQKTSSIPLNELYPPLINLWEGDSEKDKDGSADTKPTQVDTSRSYYMW

SEQ ID NO: 11105 - protein, 713 aa, Artificial Sequence
  Description of Artificial Sequence: Synthetic coding sequence
MRLLVAPLLLAWVAGATAAVPVVPWHVPCPPQCACQIRPWYTPRSSYREATTVDCNDLFLTAVPPALPAGTQTLLLQSNSIVRVDQSELGYLANLTELDLSQNSFSDARDCDFHALPQLLSLHLEENQLTRLEDHSFAGLASLQELYLNHNQLYRIAPRAFSGLSNLLRLHLNSNLLRAIDSRWFEMLPNLEILMIGGNKVDAILDMNFRPLANLRSLVLAGMNLREISDYALEGLQSLESLSFYDNQLARVPRRALEQVPGLKFLDLNKNPLQRVGPGDFANMLHLKELGLNNMEELVSIDKFALVNLPELTKLDITNNPRLSFIHPRAFHHLPQMETLMLNNNALSALHQQTVESLPNLQEVGLHGNPIRCDCVIRWANATGTRVRFIEPQSTLCAEPPDLQRLPVREVPFREMTDHCLPLISPRSFPPSLQVASGESMVLHCRALAEPEPEIYWVTPAGLRLTPAHAGRRYRVYPEGTLELRRVTAEEAGLYTCVAQNLVGADTKTVSVVVGRALLQPGRDEGQGLELRVQETHPYHILLSWVTPPNTVSTNLTWSSASSLRGQGATALARLPRGTHSYNITRLLQATEYWACLQVAFADAHTQLACVWARTKEATSCHRALGDRPGLIAILALAVLLLAAGLAAHLGTGQPRKGVGGRRPLPPAWAFWGWSAPSVRVVSAPLVLPWNPGRKLPRSSEGETLLPPLSQNS

SEQ ID NO: 11106 - protein, 713 aa, Artificial Sequence; identical to SEQ ID NO: 11105
  Description of Artificial Sequence: Synthetic coding sequence

SEQ ID NO: 11107 - protein, 713 aa, Artificial Sequence; identical to SEQ ID NO: 11105
  Description of Artificial Sequence: Synthetic coding sequence

SEQ ID NO: 11108 - protein, 708 aa, Artificial Sequence
  Description of Artificial Sequence: Synthetic coding sequence
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLNPSTEYKICIDIPTIYQKNRKKCVNVTTKGLHPDQKEYEKNNTTTLMACLGGLLGIIGVICLISCLSPEMNCDGGHSYVRNYLQKPTFALGELYPPLINLWEAGKEKSTSLKVKATVIGLPTNMS

SEQ ID NO: 11109 - protein, 708 aa, Artificial Sequence; identical to SEQ ID NO: 11108
  Description of Artificial Sequence: Synthetic coding sequence

SEQ ID NO: 11110 - protein, 708 aa, Artificial Sequence; identical to SEQ ID NO: 11108
  Description of Artificial Sequence: Synthetic coding sequence

SEQ ID NO: 11111 - protein, 740 aa, Artificial Sequence
  Description of Artificial Sequence: Synthetic coding sequence
MRQTLPLLLLTVLRPSWADPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALPPCTGPALSSLRALALAGNPLRALQPRAFACFPALQLLNLSCTALGRGAQGGIAEAAFAGEDGAPLVTLEVLDLSGTFLERVESGWIRDLPKLTSLYLRKMPRLTTLEGDIFKMTPNLQQLDCQDSPALASVATHIFQDTPHLQVLLFQNCNLSSFPPWTLDSSQVLSINLFGNPLTCSCDLSWLLTDAKRTVLSRAADTMCAPAAGSSGPFSASLSLSQLPGVCQSDQSTTLGASHPPCFNRSTYAQGTTVAPSAAPATRPAGDQQSVSKAPNVGSRTIAAWPHSDAREGTAPSTTNSVAGHSNSSVFPRAASTTRTQHRGEHAPELVLEPDISAASTPLASKLLGPFPTSWDRSISSPQPGQRTHATPQAPNPSLSEGEIPVLLLDDYSEEEEGRKEEVGTPHQDVPCDYHPCKHLQTPCAELQRRWRCRCPGLSGEDTIPDPPRLQGVTETTDTSALVHWCAPNSVVHGYQIRYSAEGWAGNQSVVGVIYATARQHPLYGLSPGTTYRVCVLAANRAGLSQPRSSGWRSPCAAFTTKPSFALLLSGLCAASGLLLASTVVLSACLCRRGQTLGLQRCDTHLVAYKNPAFDDYPLGLQTVS

SEQ ID NO: 11112 - protein, 396 aa, Artificial Sequence
  Description of Artificial Sequence: Synthetic coding sequence
MKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRREEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 11113 - protein, 491 aa, Artificial Sequence
  Description of Artificial Sequence: Synthetic coding sequence
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRLLRTCVDFFRLVPFMVFLIVPFMEFLLPVFLKLFPEMLPSTFESESKKEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 11114 - protein, 443 aa, Artificial Sequence
  Description of Artificial Sequence: Synthetic coding sequence
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRREEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 11115 - protein, 142 aa, Artificial Sequence
  Description of Artificial Sequence: Synthetic coding sequence
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWI

SEQ ID NO: 11116 - protein, 116 aa, Artificial Sequence
  Description of Artificial Sequence: Synthetic coding sequence
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIK

SEQ ID NO: 11117 - protein, 277 aa, Artificial Sequence
  Description of Artificial Sequence: Synthetic coding sequence
MEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 11118 - protein, 122 aa, Artificial Sequence
  Description of Artificial Sequence: Synthetic coding sequence
MKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRCF

SEQ ID NO: 11119 - protein, 444 aa, Artificial Sequence
  Description of Artificial Sequence: Synthetic coding sequence
MKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRLLRTCVDFFRLVPFMVFLIVPFMEFLLPVFLKLFPEMLPSTFESESKKEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 11120 - protein, 623 aa, Artificial Sequence
  Description of Artificial Sequence: Synthetic coding sequence
MRVALGMLWLLALAWPPQARGFCPSQCSCSLHIMGDGSKARTVVCNDPDMTLPPASIPPDTSRLRLERTAIRRVPGEAFRPLGRLEQLWLPYNALSELNALMLRGLRRLRELRLPGNRLAAFPWAALRDAPKLRLLDLQANRLSAVPAEAARFLENLTFLDLSSNQLMRLPQELIVSWAHLETGIFPPGHHPRRVLGLQDNPWACDCRLYDLVHLLDGWAPNLAFIETELRCASPRSLAGVAFSQLELRKCQGPELHPGVASIRSLLGGTALLRCGATGVPGPEMSWRRANGRPLNGTVHQEVSSDGTSWTLLGLPAVSHLDSGDYICQAKNFLGASETVISLIVTEPPTSTEHSGSPGALWARTGGGGEAAAYNNKLVARHVPQIPKPAVLATGPSVPSTKEELTLEHFQMDALGELSDGRAGPSEARMVRSVKVVGDTYHSVSLVWKAPQAKNTTAFSVLYAVFGQHSMRRVIVQPGKTRVTITGLLPKTKYVACVCVQGLVPRKEQCVIFSTNEVVDAENTQQLINVVVISVAIVIALPLTLLVCCSALQKRCRKCFNKDSTEATVTYVNLERLGYSEDGLEELSRHSVSEADRLLSARSSVDFQAFGVKGGRRINEYFC

SEQ ID NO: 11121 - protein, 496 aa, Artificial Sequence
  Description of Artificial Sequence: Synthetic coding sequence
MVEPHQEPRHSKVGLQDNPWFCDCHISKMIELSKVVDPAIVLLDPLMTCSEPERLTGILFQRAELEHCLKPSVMTSATKIMSALGSNVLLRCDATGFPTPQITWTRSDSSPVNYTVIQESPEEGVRWSIMSLTGISSKDAGDYKCKAKNLAGMSEAVVTVTVLGITTTPIPPDTSERTGDHPEWDVQPGSGRSTSVSSASSYLWSSSFSPTSSFSASTLSPPSTASFSLSPFSSSTVSSTTTLSTSISASTTMANKRSFQLHQGGKRNLKVAKNGSKLPPASTSKKEELALLDQTMLTETNAAIENLRVVSETKESVTLTWNMINTTHNSAVTVLYSKYGGKDLLLLNADSSKNQVTIDGLEPGGQYMACVCPKGVPPQKDQCITFSTERVEGDDSQWSLLLVVTSTACVVILPLICFLLYKVCKLQCKSEPFWEDDLAKETYIQFETLFPRSQSVGELWTRSHRDDSEKLLLCSRSSVESQVTFKSEGSRPEYYC

SEQ ID NO: 11122 - protein, 634 aa, Artificial Sequence
  Description of Artificial Sequence: Synthetic coding sequence
MDMNELPTNLPVDTVKLRIEKTVIRRISAEAFYYLVELQYLWVTYNSVASIDPSSFYNLKQLHELRLDGNSLAAFPWASLLDMPLLRTLDLHNNKITSVPNEALRYLKNLAYLDLSSNRLTTLPPDFLESWTHLVSTPSGVLDLSPSRIILGLQDNPWFCDCHISKMIELSKVVDPAIVLLDPLMTCSEPERLTGILFQRAELEHCLKPSVMTSATKIMSALGSNVLLRCDATGFPTPQITWTRSDSSPVNYTVIQESPEEGVRWSIMSLTGISSKDAGDYKCKAKNLAGMSEAVVTVTVLGITTTPIPPDTSERTGDHPEWDVQPGSGRSTSVSSASSYLWSSSFSPTSSFSASTLSPPSTASFSLSPFSSSTVSSTTTLSTSISASTTMANKRSFQLHQGGKRNLKVAKNGSKLPPASTSKKEELALLDQTMLTETNAAIENLRVVSETKESVTLTWNMINTTHNSAVTVLYSKYGGKDLLLLNADSSKNQVTIDGLEPGGQYMACVCPKGVPPQKDQCITFSTERVEGDDSQWSLLLVVTSTACVVILPLICFLLYKVCKLQCKSEPFWEDDLAKETYIQFETLFPRSQSVGELWTRSHRDDSEKLLLCSRSSVESQVTFKSEGSRPEYYC

SEQ ID NO: 11123 - protein, 496 aa, Artificial Sequence; identical to SEQ ID NO: 11121
  Description of Artificial Sequence: Synthetic coding sequence

SEQ ID NO: 11124 - protein, 1119 aa, Artificial Sequence
  Description of Artificial Sequence: Synthetic coding sequence
MSAPSLRARAAGLGLLLCAVLGRAGRSDSGGRGELGQPSGVAAERPCPTTCRCLGDLLDCSRKRLARLPEPLPSWVARLDLSHNRLSFIKASSMSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRNGVTKLMDGAFWGLSNMEILQLDHNNLTEITKGWLYGLLMLQELHLSQNAINRISPDAWEFCQKLSELDLTFNHLSRLDDSSFLGLSLLNTLHIGNNRVSYIADCAFRGLSSLKTLDLKNNEISWTIEDMNGAFSGLDKLRRLILQGNRIRSITKKAFTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVGVVIIAVVCCVVGTSLVWVVIIYHTRRRNEDCSITNTDETNLPADIPSYLSSQGTLADRQDGYVSSESGSHHQFVTSSGAGFFLPQHDSSGTCHIDNSSEADVEAATDLFLCPFLGSTGPMYLKGNVYGSDPFETYHTGCSPDPRTVLMDHYEPSYIKKKECYPCSHPSEESCERSFSNISWPSHVRKLLNTSYSHNEGPGMKNLCLNKSSLDFSANPEPASVASSNSFMGTFGKALRRPHLDAYSSFGQPSDCQPRAFYLKAHSSPDLDSGSEEDGKERTDFQEENHICTFKQTLENYRTPNFQSYDLDT

SEQ ID NO: 11125 - protein, 1059 aa, Artificial Sequence
  Description of Artificial Sequence: Synthetic coding sequence
MVDVLLLFSLCLLFHISRPDLSHNRLSFIKASSMSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRNGVTKLMDGAFWGLSNMEILQLDHNNLTEITKGWLYGLLMLQELHLSQNAINRISPDAWEFCQKLSELDLTFNHLSRLDDSSFLGLSLLNTLHIGNNRVSYIADCAFRGLSSLKTLDLKNNEISWTIEDMNGAFSGLDKLRRLILQGNRIRSITKKAFTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVGVVIIAVVCCVVGTSLVWVVIIYHTRRRNEDCSITNTDETNLPADIPSYLSSQGTLADRQDGYVSSESGSHHQFVTSSGAGFFLPQHDSSGTCHIDNSSEADVEAATDLFLCPFLGSTGPMYLKGNVYGSDPFETYHTGCSPDPRTVLMDHYEPSYIKKKECYPCSHPSEESCERSFSNISWPSHVRKLLNTSYSHNEGPGMKNLCLNKSSLDFSANPEPASVASSNSFMGTFGKALRRPHLDAYSSFGQPSDCQPRAFYLKAHSSPDLDSGSEEDGKERTDFQEENHICTFKQTLENYRTPNFQSYDLDT

SEQ ID NO: 11126 - protein, 345 aa, Artificial Sequence
  Description of Artificial Sequence: Synthetic coding sequence
MKGELLLFSSVIVLLQVVCSCPDKCYCQSSTNFVDCSQQGLAEIPSHLPPQTRTLHLQDNQIHHLPAFAFRSVPWLMTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIATVIITGVVCGIVCLMMLAAAIYGCTYAAITAQYHGGPLAQTNDPGKVEEKERFDSSPA

SEQ ID NO: 11127 - protein, 269 aa, Artificial Sequence
  Description of Artificial Sequence: Synthetic coding sequence
MTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIATVIITGVVCGIVCLMMLAAAIYGCTYAAITAQYHGGPLAQTNDPGKVEEKERFDSSPA

SEQ ID NO: 11128 - protein, 370 aa, Artificial Sequence
  Description of Artificial Sequence: Synthetic coding sequence
MLAPGSSPGQRGRLALQWRQVSWITCWIALYAVEALPTCPFSCKCDSRSLEVDCSGLGLTTVPPDVPAATRTLLLLNNKLSALPSWAFANLSSLQRLDLSNNFLDRLPRSIFGDLTNLTELQLRNNSIRTLDRDLLRHSPLLRHLDLSINGLAQLPPGLFDGLLALRSLSLRSNRLQNLDRLTFEPLANLQLLQVGDNPWECDCNLREFKHWMEWFSYRGGRLDQLACTLPKELRGKDMRMVPMEMFNYCSQLEDENSSAGLDIPGPPCTKASPEPAKPKPGAEPEPEPSTACPQKQRHRPASVRRAMGTVIIAGVVCGVVCIMMVVAAAYGCIYASLMAKYHRELKKRQPLMGDPEGEHEDQKQISSVA

SEQ ID NO: 11129 - protein, 135 aa, Artificial Sequence
  Description of Artificial Sequence: Synthetic coding sequence
MRMVPMEMFNYCSQLEDENSSAGLDIPGPPCTKASPEPAKPKPGAQHSLPTEAEAPAGEREASHGHGDHCRGRVRRRLHHDGGGRCLWLHLRLPHGQVPPGAQKAPAPDGGPRGRARGPEADLFCGLSAHPHPAR

SEQ ID NO: 11130 - protein, 370 aa, Artificial Sequence; identical to SEQ ID NO: 11128
  Description of Artificial Sequence: Synthetic coding sequence

SEQ ID NO: 11131 - protein, 370 aa, Artificial Sequence; identical to SEQ ID NO: 11128
  Description of Artificial Sequence: Synthetic coding sequence

SEQ ID NO: 11132 - protein, 499 aa, Artificial Sequence
  Description of Artificial Sequence: Synthetic coding sequence
MTLILTSLLFFGLSLGPRTRVQAENLPKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGVSRKPSLLTLQGPVVTPGENLTLQCGSDVGYIRYTLYKEGADGLPQRPGRQPQAGLSQANFTLSPVSRSYGGQYRCYGAHNVSSEWSAPSDPLDILIAGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGATETLNPAQKKSDSKTAPHLQDYTVENLIRMGVAGLVLLFLGILLFEAQHSQRSPPRCSQEANSRKDNAPFRVVEPWEQI

SEQ ID NO: 11133 - protein, 325 aa, Artificial Sequence
  Description of Artificial Sequence: Synthetic coding sequence
MANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 11134 - protein, 325 aa, Artificial Sequence; identical to SEQ ID NO: 11133
  Description of Artificial Sequence: Synthetic coding sequence

SEQ ID NO: 11135 - protein, 325 aa, Artificial Sequence; identical to SEQ ID NO: 11133
  Description of Artificial Sequence: Synthetic coding sequence

SEQ ID NO: 11136 - protein, 117 aa, Artificial Sequence
  Description of Artificial Sequence: Synthetic coding sequence
MAFSGRARPCIIPENEEIPRAALNTVHEANGTEDERAVSKLQRRHSDVKVYKEFCDFYAKFNMANALASATCERCKGGFAPAEKIVNSNGELYHEQCFVCAQCFQQFPEGLFYEERT

SEQ ID NO: 11137 - protein, 362 aa, Artificial Sequence
  Description of Artificial Sequence: Synthetic coding sequence
MTALQLKELSHSGLYRRRRDRPDSLRVNGLPEEELSNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 11138 - protein, 329 aa, Artificial Sequence
  Description of Artificial Sequence: Synthetic coding sequence
MTCNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 11139 - protein, 387 aa, Artificial Sequence
  Description of Artificial Sequence: Synthetic coding sequence
MAFSGRARPCIIPENEEIPRAALNTVHEANGTEDERAVSKLQRRHSDVKVYKEFCDFYAKFNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 11140 - protein, 337 aa, Artificial Sequence
  Description of Artificial Sequence: Synthetic coding sequence
MLGVAAGMTHSNMANALASATCERCKGGFAPAEKIVNSNGELYHEQCFVCAQCFQQFPEGLFYEFEGRKYCEHDFQMLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGKELTADARELKGELYCLPCHDKMGVPICGACRRPIEGRVVNAMGKQWHVEHFVCAKCEKPFLGHRHYERKGLAYCETHYNQLFGDVCFHCNRVIEGDVVSALNKAWCVNCFACSTCNTKLTLKNKFVEFDMKPVCKKCYEKFPLELKKRLKKLAETLGRK

SEQ ID NO: 11141 - protein, 365 aa, Artificial Sequence
  Description of Artificial Sequence: Synthetic coding sequence
MAARLGALAASGLYRRRQHRQSPPPATGNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 11142 - protein, 249 aa, Artificial Sequence
  Description of Artificial Sequence: Synthetic coding sequence
MESRHPAVAEIACTCWALLHLANPEGRGHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 11143 - protein, 341 aa, Artificial Sequence
  Description of Artificial Sequence: Synthetic coding sequence
MTGSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 11144 - protein, 189 aa, Artificial Sequence
  Description of Artificial Sequence: Synthetic coding sequence
MFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 11145 - protein, 189 aa, Artificial Sequence; identical to SEQ ID NO: 11144
  Description of Artificial Sequence: Synthetic coding sequence

SEQ ID NO: 11146 - protein, 336 aa, Artificial Sequence
  Description of Artificial Sequence: Synthetic coding sequence
MSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 11147 - protein, 189 aa, Artificial Sequence; identical to SEQ ID NO: 11144
  Description of Artificial Sequence: Synthetic coding sequence

SEQ ID NO: 11148 - protein, 336 aa, Artificial Sequence; identical to SEQ ID NO: 11146
  Description of Artificial Sequence: Synthetic coding sequence

SEQ ID NO: 11149 - protein, 336 aa, Artificial Sequence; identical to SEQ ID NO: 11146
  Description of Artificial Sequence: Synthetic coding sequence

SEQ ID NO: 11150 - protein, 189 aa, Artificial Sequence; identical to SEQ ID NO: 11144
  Description of Artificial Sequence: Synthetic coding sequence

SEQ ID NO: 11151 - protein, 336 aa, Artificial Sequence; identical to SEQ ID NO: 11146
  Description of Artificial Sequence: Synthetic coding sequence

SEQ ID NO: 11152 - protein, 146 aa, Artificial Sequence
  Description of Artificial Sequence: Synthetic coding sequence
MSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQP

SEQ ID NO: 11153 - protein, 189 aa, Artificial Sequence; identical to SEQ ID NO: 11144
  Description of Artificial Sequence: Synthetic coding sequence

SEQ ID NO: 11154 - protein, 363 aa, Artificial Sequence
  Description of Artificial Sequence: Synthetic coding sequence
MTGRKRKWGETGTGSGAAPAAALRWSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 11155 - protein, 363 aa, Artificial Sequence; identical to SEQ ID NO: 11154
  Description of Artificial Sequence: Synthetic coding sequence

SEQ ID NO: 11156 - protein, 233 aa, Artificial Sequence
  Description of Artificial Sequence: Synthetic coding sequence
MLKPSVTSAPTADMATLTVVQPLTLDRDVARAIELLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVSVEGEHHEKAVELLKAAKDSVKLVVRYTPKVLEEMEARFEKLRTARRRQQQQLLIQQQQQQQQQQTQQNHMS

SEQ ID NO: 11157 - protein, 682 aa, Artificial Sequence
  Description of Artificial Sequence: Synthetic coding sequence
MTCPPTGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 11158 - protein, 594 aa, Artificial Sequence
  Description of Artificial Sequence: Synthetic coding sequence
MAGSRLPRQLFLQGVAAVFMFAFASLYTQIPGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 11159 - protein, 707 aa, Artificial Sequence
  Description of Artificial Sequence: Synthetic coding sequence
MAGSRLPRQLFLQGVAAVFMFAFASLYTQIPGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 11160 - protein, 325 aa, Artificial Sequence
  Description of Artificial Sequence: Synthetic coding sequence
MAVGNNTQRSYSIIPCFIFVELVIMAGTVLLAYYFECTDTFQVHIQGFFCQDGDLMKPYPGTEEESFITPLVLYCVLAATPTAIIFIGEISMYFIKSTRESLIAQEKTILTGECCYLNPLLRRIIRFTGVFAFGLFATDIFVNAGQVVTGHLTPYFLTVCKPNYTSADCQAHHQFINNGNICTGDLEVIEKARRSFPSKHAALSIYSALYATMYITSTIKTKSSRLAKPVLCLGTLCTAFLTGLNRVSEYRNHCSDVIAGFILGTAVALFLGMCVVHNFKGTQGSPSKPKPEDPRGVPLMAFPRIESPLETLSAQNHSASMTEVT

SEQ ID NO: 11161 - protein, 325 aa, Artificial Sequence; identical to SEQ ID NO: 11160
  Description of Artificial Sequence: Synthetic coding sequence

SEQ ID NO: 11162 - protein, 325 aa, Artificial Sequence; identical to SEQ ID NO: 11160
  Description of Artificial Sequence: Synthetic coding sequence

SEQ ID NO: 11163 - protein, 103 aa, Artificial Sequence
  Description of Artificial Sequence: Synthetic coding sequence
MAVGNNTQRSYSIIPCFIFVELVIMAGTVLLAYYFECTDTFQVHIQGFFCQDGDLMKPYPGTEEESFITPLVLYCVLAATPTAIIFIGEISMYFIKSTRESLI

SEQ ID NO: 11164 - protein, 343 aa, Artificial Sequence
  Description of Artificial Sequence: Synthetic coding sequence
MAGGRPHLKRSFSIIPCFVFVESVLLGIVILLAYRLEFTDTFPVHTQGFFCYDSTYAKPYPGPEAASRVPPALVYALVTAGPTLTILLGELARAFFPAPPSAVPVIGESTIVSGACCRFSPPVRRLVRFLGVYSFGLFTTTIFANAGQVVTGNPTPHFLSVCRPNYTALGCLPPSPDRPGPDRFVTDQGACAGSPSLVAAARRAFPCKDAALCAYAVTYTAMYVTLVFRVKGSRLVKPSLCLALLCPAFLVGVVRVAEYRNHWSDVLAGFLTGAAIATFLVTCVVHNFQSRPPSGRRLSPWEDLGQAPTMDSPLEKNPRSAGRIRHRHGSPHPSRRTAPAVAT

SEQ ID NO: 11165 - protein, 427 aa, Artificial Sequence
  Description of Artificial Sequence: Synthetic coding sequence
MAGGRPHLKRSFSIIPCFVFVEGFFCYDSTYAKPYPGPEAASRVPPALVYALVTAGPTLTILLGELARAFFPAPPSAVPVIGESTIVSGACCRFSPPVRRLVRFLGVYSFGLFTTTIFANAGQVVTGNPTPHFLSVCRPNYTALGCLPPSPDRPGPDRFVTDQGACAGSPSLVAAARRAFPCKDAALCAYAVTYTAMYVTLVFRVKGSRLVKPSLCLALLCPAFLVGVVRVAEYRNHWSDVLAGFLTGAAIATFLVTCVVHNFQSRPPSGRRLSPWEDLGQAPTMDSPLEKLSVAQEPEVCRPHSTPARLTPSKSQNCARRGHLIPSCVSSRAPAMCSSPRVPRPRLRSEPTPLPLPLPLPAPTPSQGPSPSSPGPGGPGGGGGRGRKLLLPTPLLRDLYTLSGLYPSPFHRDNFSPYLFASRDHLL

SEQ ID NO: 11166 - protein, 719 aa, Artificial Sequence
  Description of Artificial Sequence: Synthetic coding sequence
MISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLRRTVRFVAGVHVFGLCATALVTDVIQLATGYHTPFFLTVCKPNYTLLGTSCEVNPYITQDICSGHDIHAILSARKTFPSQHATLSAFAAVYVSMYFNSVISDTTKLLKPILVFAFAIAAGVCGLTQITQYRSHPVDVYAGFLIGAGIAAYLACHAVGNFQAPPAEKPAAPAPAKDALRALTQRGHDSVYQQNKSVSTDELGPPGRLEGAPRPVAREKTSLGSLKRASVDVDLLAPRSPMAKENMVTFSHTLPRASAPSLDDPARRHMTIHVPLDASRSKQLISEWKQKSLEGRGLGLPDDASPGHLRAPAEPMAEEEEEEEDEEEEEEEEEEEDEGPAPPSLYPTVQARPGLGPRVILPPRAGPPPLVHIPEEGAQTGAGLSPKSGAGVRAKWLMMAEKSGAAVANPPRLLQVIAMSKAPGAPGPKAAETASSSSASSDSSQYRSPSDRDSASIVTIDAHAPHHPVVHLSAGGAPWEWKAAGGGAKAEADGGYELGDLARGFRGGAKPPGVSPGSSVSDVDQEEPRFGAVATVNLATGEGLPPLGAADGALGPGSRESTLRRHAGGLGLAEREAEAEAEGYFRKMQARRFPD

SEQ ID NO: 11167 - protein, 746 aa, Artificial Sequence
  Description of Artificial Sequence: Synthetic coding sequence
MISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLRRTVRFVGVHVFGLCATALVTDVIQLATGYHTPFFLTVCKPNYTLLGTSCEVNPYITQDICSGHDIHAILSARKTFPSQHATLSAFAAVYVSVSPAPHCPSQALLLTRGEPSLTPTPMPQMYFNSVISDTTKLLKPILVFAFAIAAGVCGLTQITQYRSHPVDVYAGFLIGAGIAAYLACHAVGNFQAPPAEKPAAPAPAKDALRALTQRGHDSVYQQNKSVSTDELGPPGRLEGAPRPVAREKTSLGSLKRASVDVDLLAPRSPMAKENMVTFSHTLPRASAPSLDDPARRHMTIHVPLDASRSKQLISEWKQKSLEGRGLGLPDDASPGHLRAPAEPMAEEEEEEEDEEEEEEEEEEEDEGPAPPSLYPTVQARPGLGPRVILPPRAGPPPLVHIPEEGAQTGAGLSPKSGAGVRAKWLMMAEKSGAAVANPPRLLQVIAMSKAPGAPGPKAAETASSSSASSDSSQYRSPSDRDSASIVTIDAHAPHHPVVHLSAGGAPWEWKAAGGGAKAEADGGYELGDLARGFRGGAKPPGVSPGSSVSDVDQEEPRFGAVATVNLATGEGLPPLGAADGALGPGSRESTLRRHAGGLGLAEREAEAEAEGYFRKMQARRFPD

SEQ ID NO: 11168 - protein, 718 aa, Artificial Sequence
  Description of Artificial Sequence: Synthetic coding sequence
MISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLRRTVRFVGVHVFGLCATALVTDVIQLATGYHTPFFLTVCKPNYTLLGTSCEVNPYITQDICSGHDIHAILSARKTFPSQHATLSAFAAVYVSMYFNSVISDTTKLLKPILVFAFAIAAGVCGLTQITQYRSHPVDVYAGFLIGAGIAAYLACHAVGNFQAPPAEKPAAPAPAKDALRALTQRGHDSVYQQNKSVSTDELGPPGRLEGAPRPVAREKTSLGSLKRASVDVDLLAPRSPMAKENMVTFSHTLPRASAPSLDDPARRHMTIHVPLDASRSKQLISEWKQKSLEGRGLGLPDDASPGHLRAPAEPMAEEEEEEEDEEEEEEEEEEEDEGPAPPSLYPTVQARPGLGPRVILPPRAGPPPLVHIPEEGAQTGAGLSPKSGAGVRAKWLMMAEKSGAAVANPPRLLQVIAMSKAPGAPGPKAAETASSSSASSDSSQYRSPSDRDSASIVTIDAHAPHHPVVHLSAGGAPWEWKAAGGGAKAEADGGYELGDLARGFRGGAKPPGVSPGSSVSDVDQEEPRFGAVATVNLATGEGLPPLGAADGALGPGSRESTLRRHAGGLGLAEREAEAEAEGYFRKMQARRFPD

SEQ ID NO: 11169 - protein, 577 aa, Artificial Sequence
  Description of Artificial Sequence: Synthetic coding sequence
MQRAGSSGGRGECDISGAGRLGLEEAARLSCAVHTSPGGGRRPGQAAGMSAKERPKGKVIKDSVTLLPCFYFVELPILASSVVSLYFLELTDVFKPVHSGFSCYDRSLSMPYIEPTQEAIPFLMLLSLAFAGPAITIMVGEGILYCCLSKRRNGVGLEPNINAGGCNFNSFLRRAVRFVGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSRVSSKAAPRTLKAARSPALAPSAIKP

SEQ ID NO: 11170 - protein, 605 aa, Artificial Sequence
  Description of Artificial Sequence: Synthetic coding sequence
MNMFDADTTTNLVTISFILPIGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 11171 - protein, 763 aa, Artificial Sequence
  Description of Artificial Sequence: Synthetic coding sequence
MQRAGSSGGRGECDISGAGRLGLEEAARLSCAVHTSPGGGRRPGQAAGMSAKERPKGKVIKDSVTLLPCFYFVELPILASSVVSLYFLELTDVFKPVHSGFSCYDRSLSMPYIEPTQEAIPFLMLLSLAFAGPAITIMVGEGILYCCLSKRRNGVGLEPNINAGGCNFNSFLRRAVRFVGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 11172 - protein, 705 aa, Artificial Sequence
  Description of Artificial Sequence: Synthetic coding sequence
MQRAGSSGGRGECDISGAGRLGLEEAARLSCAVHTSPGGGRRPGQAAGMSAKERPKGKVIKDSVTLLPCFYFVELPILASSVVSLYFLELTDVFKPVHSGFSCYDRSLSMPYIEPTQEAIPFLMLLSLAFAGPAITIMVGEGILYCCLSKRRNGVGLEPNINAGGCNFNSFLRRAVRFVGVHVFGLCSTALITDIIQLSTGYQAPYFLTVCKPNYTSLNVSCKENSYIVEDICSGSDLTVINSGRKSFPSQHATLAAFAAVYVSGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 11173 - protein, 321 aa, Artificial Sequence
  Description of Artificial Sequence: Synthetic coding sequence
MPLLPAALTSSMLYFQMVIMAGTVMLAYYFEYTDTFTVNVQGFFCHDSAYRKPYPGPEDSSAVPPVLLYSLAAGVPVLVIIVGETAVFCLQLATRDFENQEKTILTGDCCYINPLVRRTVRFLGIYTFGLFATDIFVNAGQVVTGNLAPHFLALCKPNYTALGCQQYTQFISGEEACTGNPDLIMRARKTFPSKEAALSVYAAMYLTMYITNTIKAKGTRLAKPVLCLGLMCLAFLTGLNRVAEYRNHWSDVIAGFLVGISIAVFLVVCVVNNFKGRQAENEHIHMDNLAQMPMISIPRVESPLEKVTSVQNHITAFAEVT

SEQ ID NO: 11174 - protein, 316 aa, Artificial Sequence
  Description of Artificial Sequence: Synthetic coding sequence
MPLLPAALTSSMLYFQMVIMAGTVMLAYYFEYTDTFTVNVQGFFCHDSAYRKPYPGPEDSSAVPPVLLYSLAAGVPVLVIIVGETAVFCLQLATRDFENQEKTILTGDCCYINPLVRRTVRFLGIYTFGLFATDIFVNAGQVVTGNLAPHFLALCKPNYTALGCQQYTQFISGEEACTGNPDLIMRARKTFPSKEAALSVYAAMYLTMYITNTIKAKGTRLAKPVLCLGLMCLAFLTGLNRVAEYRNHWSDVIAGFLVGISIAVFLVVCVVNNFKGRQAENEHIHMDNLAQMPMISIPRVESPLEKNHITAFAEVT

SEQ ID NO: 11175 - protein, 247 aa, Artificial Sequence
  Description of Artificial Sequence: Synthetic coding sequence
MLPSQEASKLYHEHYMRNSRAIGVLWAIFTICFAIINVVVFIQPYWVGDSVSTPKPGYFGLFHYCVGSGLAGRELTCRGSFTDFSTIPSSAFKAAAFFVLLSMVLILGCITCFSLFFFCNTATVYKICAWMQLLAALCLVLGCMIFPDGWDAETIRDMCGAKTGKYSLGDCSVRWAYILAIIGILNALILSFLAFVLGNRQTDLLQEELKPENKDFVGSTVSSVLRPGGDVSGWGVLPCPVAHSQGP

SEQ ID NO: 11176 - protein, 695 aa, Artificial Sequence
  Description of Artificial Sequence: Synthetic coding sequence
MSGAALGLEIVFVFFLALFLLHRYGDFKKQHRLVIIGTLLAWYLCFLIVFILPLDVSTTIYNRCKHAAANSSPPENSNITGLYATANPVPSQHPCFKPWSYIPDGIMPIFWRVVYWTSQFLTWILLPFMQSYARSGGFSITGKIKTALIENAIYYGTYLLIFGAFLIYVAVNPHLHLEWNQLQTIGIAAANTWGLFLLVLLLGYGLVEIPRSYWNGAKRGYLLMKTYFKAAKLMTEKADAEENLEDAMEEVRKVNESIKYNHPLRKCVDTILKKCPTEYQEKMGRNMDDYEDFDEKHSIYPSEKSLVKLHKQVIYSVQRHRRTQVQWQILLEQAFYLEDVAKNETSATHQFVHTFQSPEPENRFIQYFYNPTFEWYWECLLRPWFYKILAVVLSIFSVIVVWSECTFFSTTPVLSLFAVFIQLAEKTYNYIYIEIACFLSIFFLSICVYSTVFRIRVFNYYYLASHHQTDAYSLLFSGMLFCRLTPPLCLNFLGLTHMDSSISHKNTQPTAYTSIMGSMKVLSFIADGFYIYYPMLVVILCIATYFSLGTRCLNLLGFQQFMGDDDMTSDLVNEGKELIRKEKRKRQRQEEGENRRREWKERYGHNREDSTRNRNIHTDPKESNFSDVNTNRSAFKYTRANNRTERDRIELLQDAEPLDFNAETFTDDPLESESGRYQPGGRYLSMSRSDIFNDV

SEQ ID NO: 11177 - protein, 589 aa, Artificial Sequence
  Description of Artificial Sequence: Synthetic coding sequence
MPIFWRVVYWTSQFLTWILLPFMQSYARSGGFSITGKIKTALIENAIYYGTYLLIFGAFLIYVAVNPHLHLEWNQLQTIGIAAANTWGLFLLVLLLGYGLVEIPRSYWNGAKRGYLLMKTYFKAAKLMTEKADAEENLEDAMEEVRKVNESIKYNHPLRKCVDTILKKCPTEYQEKMGRNMDDYEDFDEKHSIYPSEKSLVKLHKQVIYSVQRHRRTQVQWQILLEQAFYLEDVAKNETSATHQFVHTFQSPEPENRFIQYFYNPTFEWYWECLLRPWFYKILAVVLSIFSVIVVWSECTFFSTTPVLSLFAVFIQLAEKTYNYIYIEIACFLSIFFLSICVYSTVFRIRVFNYYYLASHHQTDAYSLLFSGMLFCRLTPPLCLNFLGLTHMDSSISHKNTQPTAYTSIMGSMKVLSFIADGFYIYYPMLVVILCIATYFSLGTRCLNLLGFQQFMGDDDMTSDLVNEGKELIRKEKRKRQRQEEGENRRREWKERYGHNREDSTRNRNIHTDPKESNFSDVNTNRSAFKYTRANNRTERDRIELLQDAEPLDFNAETFTDDPLESESGRYQPGGRYLSMSRSDIFNDV

SEQ ID NO: 11178 - protein, 205 aa, Artificial Sequence
  Description of Artificial Sequence: Synthetic coding sequence
MNKVFPQGENGYTAAESKAHPGGEAGGGHLCCSRRGACLSASLLLLLATVAALIALVTILGLPSCTPGAQACITLTNRTGFLCHDQRSCIPASGVCDGVRTCTHGEDEDESLCRDVPQSLPHFLVAHCGDPASWIYSDQKCDGTNNCGDCSDELSPVTVCPPCGPGWWRCPSTFFKYCDCIPRHLCRDHVQHCSDWSDEYACPGP

SEQ ID NO: 11179 - protein, 116 aa, Artificial Sequence
  Description of Artificial Sequence: Synthetic coding sequence
MNKVFPQGENGYTAAESKAHPGGEGDVPQSLPHFLVAHCGDPASWIYSDQKCDGTNNCGDCSDELSPVTVCPPCGPGWWRCPSTFFKYCDCIPRHLCRDHVQHCSDWSDEYACPGP

SEQ ID NO: 11180 - protein, 272 aa, Artificial Sequence
  Description of Artificial Sequence: Synthetic coding sequence
MEACCLLQLPQRLLLLGAAALTATALETADLAELCGQTWQGDGLLLRSHAASRRFYFVAPDTDCGLWVQAAAPGDRIRFQFRFFLVYSLTPAPPALNTSSPAPADPCAPGSYLQFYEGPPGAPRPLGSPLCGLNIPVPVASSGPFLGLRLVTRGRQPRVDFVGEVTSFRLGPCGAYFRCQNGRCIPSSLVCDPWGMDNCGDGSDQGSWSPADCRGPSPVPSQTGSTDAHTSRSLTPSPALGSAGSLWIAAERSSPAGRDPTRQDAALEGSTE

SEQ ID NO: 11181 - protein, 272 aa, Artificial Sequence; identical to SEQ ID NO: 11180
  Description of Artificial Sequence: Synthetic coding sequence

SEQ ID NO: 11182 - protein, 345 aa, Artificial Sequence
  Description of Artificial Sequence: Synthetic coding sequence
MWLLGPLCLLLSSAAESQLLPGNNFTNECNIPGNFMCSNGRCIPGAWQCDGLPDCFDKSDEKECPKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSITYAIIGSSVIFVLVVALLALVLHHQRKRNNLMTLPVHRLQHPVLLSRLVVLDHPHHCNVTYNVNNGIQYVASQAEQNASEVGSPPSYSEALLDQRPAWYDLPPPPYSSDTESLNQADLPPYRSRSGSANSASSQAASSLLSVEDTSHSPGQPGPQEGTAEPRDSEPSQGTEEV

SEQ ID NO: 11183 - protein, 155 aa, Artificial Sequence
  Description of Artificial Sequence: Synthetic coding sequence
MWLLGPLCLLLSSAAESQLLPGNNFTNECNIPGNFMCSNGRCIPGAWQCDGLPDCFDKSDEKECPKAKSKCGPTFFPCASGIHCIIGRFRCNGFEDCPDGSDEENCKNGLCIDKSFICDGQNNCQDNSDEESCESSQGLRGMTFLHRPTLLTRNL

SEQ ID NO: 11184 - protein, 500 aa, Artificial Sequence
  Description of Artificial Sequence: Synthetic coding sequence
MASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPDSSSSGKNRKEESYIFESKGDGGGGEHPAPETGAVLPLALGLAITALLLLMVACRLRLVKQKLKKARPITSEESDYLINGMYL

SEQ ID NO: 11185 - protein, 325 aa, Artificial Sequence
  Description of Artificial Sequence: Synthetic coding sequence
MASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGDGWSICCICSKREAKEFSETS

SEQ ID NO: 11186 - protein, 245 aa, Artificial Sequence
  Description of Artificial Sequence: Synthetic coding sequence
MKVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPDSSSSGKNRKEESYIFESKGDGGGGEHPAPETGAVLPLALGLAITALLLLMVACRLRLVKQKLKKARPITSEESDYLINGMYL

SEQ ID NO: 11187 - protein, 859 aa, Artificial Sequence
  Description of Artificial Sequence: Synthetic coding sequence
MACRWSTKESPRWRSALLLLFLAGVYGNGALAEHSENVHISGVSTACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESWVCDSQDDCGDGSDEENCPVIVPTRVITAAVIGSLICGLLLVIALGCTCKLYSLRMFERRSFETQLSRVEAELLRREAPPSYGQLIAQGLIPPVEDFPVCSPNQASVLENLRLAVRSQLGFTSVRLPMAGRSSNIWNRIFNFARSRHSGSLALVSADGDEVVPSQSTSREPERNHTHRSLFSVESDDTDTENERRDMAGASGGVAAPLPQKVPPTTAVEATVGACASSSTQSTRGGHADNGRDVTSVEPPSVSPARHQLTSALSRMTQGLRWVRFTLGRSSSLSQNQSPLRQLDNGVSGREDDDDVEMLIPISDGSSDFDVNDCSRPLLDLASDQGQGLRQPYNATNPGVRPSNRDGPCERCGIVHTAQIPDTCLEVTLKNETSDDEALLLC

SEQ ID NO: 11188 - protein, 840 aa, Artificial Sequence
  Description of Artificial Sequence: Synthetic coding sequence
MACRWSTKESPRWRSALLLLFLAGVYACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESWVCDSQDDCGDGSDEENCPVIVPTRVITAAVIGSLICGLLLVIALGCTCKLYSLRMFERRSFETQLSRVEAELLRREAPPSYGQLIAQGLIPPVEDFPVCSPNQASVLENLRLAVRSQLGFTSVRLPMAGRSSNIWNRIFNFARSRHSGSLALVSADGDEVVPSQSTSREPERNHTHRSLFSVESDDTDTENERRDMAGASGGVAAPLPQKVPPTTAVEATVGACASSSTQSTRGGHADNGRDVTSVEPPSVSPARHQLTSALSRMTQGLRWVRFTLGRSSSLSQNQSPLRQLDNGVSGREDDDDVEMLIPISDGSSDFDVNDCSRPLLDLASDQGQGLRQPYNATNPGVRPSNRDGPCERCGIVHTAQIPDTCLEVTLKNETSDDEALLLC

SEQ ID NO: 11189 - protein, 2863 aa, Artificial Sequence
  Description of Artificial Sequence: Synthetic coding sequence
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDASEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHVCIFKLRENSKATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 11190 - protein, 2852 aa, Artificial Sequence
  Description of Artificial Sequence: Synthetic coding sequence
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDASEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 11191 - protein, 238 aa, Artificial Sequence
  Description of Artificial Sequence: Synthetic coding sequence
MLGSPCLLWLLAVTFLVPRAQPLAPQDFEEEEADETETAWPPLPAVPCDYDHCRHLQVPCKELQRVGPAACLCPGLSSPAQPPDPPRMGEVRIAAEEGRAVVHWCAPFSPVLHYWLLLWDGSEAAQKGPPLNATVRRAELKGLKPGGIYVVCVVAANEAGASRVPQAGGEGLEGADIPAFGPCSRLAVPPNPRTLVHAAVGVGTALALLSCAALVWHFCLRDRWGCPRRAAARAAGAL

SEQ ID NO: 11192 - protein, 89 aa, Artificial Sequence
  Description of Artificial Sequence: Synthetic coding sequence
MCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 11193 - protein, 141 aa, Artificial Sequence
  Description of Artificial Sequence: Synthetic coding sequence
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 11194 - protein, 164 aa, Artificial Sequence
  Description of Artificial Sequence: Synthetic coding sequence
MQAPRAAPAAPLSYDRRPRDSGRMWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 11195 - protein, 125 aa, Artificial Sequence
  Description of Artificial Sequence: Synthetic coding sequence
MRGTRLALLALVLAACGELAPALRCYVCPEPTGVSDCVTIATCTTNETMCKTTLYSREIVYPFQGDSTVTKSCASKCKPSDVDGIGQTLPVSCCNTELCNVDGAPALNSLHCGALTLLPLLSLRL

SEQ ID NO: 11196 - protein, 246 aa, Artificial Sequence
  Description of Artificial Sequence: Synthetic coding sequence
MGPQHLRLVQLFCLLGAISTLPRAGALLCYEATASRFRAVAFHNWKWLLMRNMVCKLQEGCEETLVFIETGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 11197 - protein, 211 aa, Artificial Sequence
  Description of Artificial Sequence: Synthetic coding sequence
MGPQHLRLVQLFCLLGAISTLPRMSCGAGCYKTQKGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 11198 - protein, 251 aa, Artificial Sequence
  Description of Artificial Sequence: Synthetic coding sequence
MAMGVPRVILLCLFGAALCLTGSQALQCYSFEHTYFGPFDLRAMKLPSISCPHECFEAILSLDTGYRAPVTLVRKGCWTGPPAGQTQSNADALPPDYSVVRGCTTDKCNAHLMTHDALPNLSQAPDPPTLSGAECYACIGVHQDDCAIGRSRRVQCHQDQTACFQGNGRMTVGNFSVPVYIRTCHRPSCTTEGTTSPWTAIDLQGSCCEGYLCNRKSMTQPFTSASATTPPRALQVLALLLPVLLLVGLSA

SEQ ID NO: 11199 - protein, 208 aa, Artificial Sequence
  Description of Artificial Sequence: Synthetic coding sequence
MKLPSISCPHECFEAILSLDTGYRAPVTLVRKGCWTGPPAGQTQSNADALPPDYSVVRGCTTDKCNAHLMTHDALPNLSQAPDPPTLSGAECYACIGVHQDDCAIGRSRRVQCHQDQTACFQGNGRMTVGNFSVPVYIRTCHRPSCTTEGTTSPWTAIDLQGSCCEGYLCNRKSMTQPFTSASATTPPRALQVLALLLPVLLLVGLSA

SEQ ID NO: 11200 - protein, 207 aa, Artificial Sequence [sequence omitted]

SEQ ID NO: 11201 - protein, 183 aa, Artificial Sequence
  Description of Artificial Sequence: Synthetic coding sequence
MLYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 11202 - protein, 207 aa, Artificial Sequence
  Description of Artificial Sequence: Synthetic coding sequence
MLLITLSANLFTVPERSLTTTFSFSRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 11203 - protein, 183 aa, Artificial Sequence; identical to SEQ ID NO: 11201
  Description of Artificial Sequence: Synthetic coding sequence

SEQ ID NO: 11204 - protein, 125 aa, Artificial Sequence
  Description of Artificial Sequence: Synthetic coding sequence
MKALMLLTLSVLLCWVSADIRCHSCYKVPVLGCVDRQSCRLEPGQQCLTTHAYLGKMWVFSNLRCGTPEEPCQEAFNQTNRKLGLTYNTTCCNKDNCNSAGPRPTPALGLVFLTSLAGLGLWLLH

SEQ ID NO: 11205 - protein, 125 aa, Artificial Sequence; identical to SEQ ID NO: 11204
  Description of Artificial Sequence: Synthetic coding sequence

SEQ ID NO: 11206 - protein, 125 aa, Artificial Sequence; identical to SEQ ID NO: 11204
  Description of Artificial Sequence: Synthetic coding sequence

SEQ ID NO: 11207 - protein, 125 aa, Artificial Sequence; identical to SEQ ID NO: 11204
  Description of Artificial Sequence: Synthetic coding sequence

SEQ ID NO: 11208 - protein, 125 aa, Artificial Sequence; identical to SEQ ID NO: 11204
  Description of Artificial Sequence: Synthetic coding sequence

SEQ ID NO: 11209 - protein, 125 aa, Artificial Sequence; identical to SEQ ID NO: 11204
  Description of Artificial Sequence: Synthetic coding sequence

SEQ ID NO: 11210 - protein, 125 aa, Artificial Sequence; identical to SEQ ID NO: 11204
  Description of Artificial Sequence: Synthetic coding sequence

SEQ ID NO: 11211 - protein, 69 aa, Artificial Sequence
  Description of Artificial Sequence: Synthetic coding sequence
MWVFSNLRCGTPEEPCQEAFNQTNRKLGLTYNTTCCNKDNCNSAGPRPTPALGLVFLTSLAGLGLWLLH

SEQ ID NO: 11212 - protein, 69 aa, Artificial Sequence; identical to SEQ ID NO: 11211
  Description of Artificial Sequence: Synthetic coding sequence

SEQ ID NO: 11213 - protein, 297 aa, Artificial Sequence
  Description of Artificial Sequence: Synthetic coding sequence
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRDASIPQFKPEIQVYENIHLARLGPPAHKPR

SEQ ID NO: 11214 - protein, 297 aa, Artificial Sequence; identical to SEQ ID NO: 11213
  Description of Artificial Sequence: Synthetic coding sequence

SEQ ID NO: 11215 - protein, 297 aa, Artificial Sequence; identical to SEQ ID NO: 11213
  Description of Artificial Sequence: Synthetic coding sequence

SEQ ID NO: 11216 - protein, 297 aa, Artificial Sequence; identical to SEQ ID NO: 11213
  Description of Artificial Sequence: Synthetic coding sequence

SEQ ID NO: 11217 - protein, 297 aa, Artificial Sequence; identical to SEQ ID NO: 11213
  Description of Artificial Sequence: Synthetic coding sequence

SEQ ID NO: 11218 - protein, 382 aa, Artificial Sequence
  Description of Artificial Sequence: Synthetic coding sequence
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 11219 - protein, 382 aa, Artificial Sequence; identical to SEQ ID NO: 11218
  Description of Artificial Sequence: Synthetic coding sequence

SEQ ID NO: 11220 - protein, 382 aa, Artificial Sequence; identical to SEQ ID NO: 11218
  Description of Artificial Sequence: Synthetic coding sequence

SEQ ID NO: 11221 - protein, 1722 aa, Artificial Sequence
  Description of Artificial Sequence: Synthetic coding sequence
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPDYTAIAIIVATLSILVLMGGLIWFLFQRHRLHLAGFSSVRYAQGVNEDEIMLPSFHD

SEQ ID NO: 11222 - protein, 1817 aa, Artificial Sequence
  Description of Artificial Sequence: Synthetic coding sequence
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 11223 - protein, 1873 aa, Artificial Sequence
  Description of Artificial Sequence: Synthetic coding sequence
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLDCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 11224 - protein, 382 aa, Artificial Sequence
  Description of Artificial Sequence: Synthetic coding sequence
MRSHFLQWALATSRNKDQITNIFSGFAGLLAILLVVAVFCILWNWNKRKKRQVPYLRVTVMPLLTLPQTRQRAKNIYDILPWRQEDLGRHESRSMRIFSTESLLSRNSESPEHVPSQAGNAFQEHTAHIHATEYAVGIYDNAMVPQMCGNLTPSAHCINVRASRDCASISSEDSHDYVNVPTAEEIAETLASTKSPSRNLFVLPSTQKLEFTEERDEGCGDAGDCTSLYSPGAEDSDSLSNGEGSSQISNDYVNMTGLDLSAIQERQLWVAFQCCRDYENVPAADPSGSQQQAEKDVPSSNIGHVEDKTDDPGTHVQCVKRTFLASGDYADFQPFTQSEDSQMKHREEMSNEDSSDYENVLTAKLGGRDSEQGPGTQLLPDE

SEQ ID NO: 11225 - protein, 398 aa, Artificial Sequence
  Description of Artificial Sequence: Synthetic coding sequence
MDGVTPTLSTIRGRTLESSTLHVTPRSLDRNKDQITNIFSGFAGLLAILLVVAVFCILWNWNKRKKRQVPYLRVTVMPLLTLPQTRQRAKNIYDILPWRQEDLGRHESRSMRIFSTESLLSRNSESPEHVPSQAGNAFQEHTAHIHATEYAVGIYDNAMVPQMCGNLTPSAHCINVRASRDCASISSEDSHDYVNVPTAEEIAETLASTKSPSRNLFVLPSTQKLEFTEERDEGCGDAGDCTSLYSPGAEDSDSLSNGEGSSQISNDYVNMTGLDLSAIQERQLWVAFQCCRDYENVPAADPSGSQQQAEKDVPSSNIGHVEDKTDDPGTHVQCVKRTFLASGDYADFQPFTQSEDSQMKHREEMSNEDSSDYENVLTAKLGGRDSEQGPGTQLLPDE

SEQ ID NO: 11226 - protein, 122 aa, Artificial Sequence
  Description of Artificial Sequence: Synthetic coding sequence
MTTATRQEVLGLYRSIFRLARKWQATSGQMEDTIKEKQYILNEARTLFRKNKNLTDTDLIKQCIDECTARIEIGLHYKIPYPRPIHLPPMGLTPLRGRGLRSQEKLRKLSKPVYLRSHDEVS

SEQ ID NO: 11227 - protein, 122 aa, Artificial Sequence; identical to SEQ ID NO: 11226
  Description of Artificial Sequence: Synthetic coding sequence

SEQ ID NO: 11228 - protein, 122 aa, Artificial Sequence; identical to SEQ ID NO: 11226
  Description of Artificial Sequence: Synthetic coding sequence

SEQ ID NO: 11229 - protein, 122 aa, Artificial Sequence; identical to SEQ ID NO: 11226
  Description of Artificial Sequence: Synthetic coding sequence

SEQ ID NO: 11230 - protein, 88 aa, Artificial Sequence
  Description of Artificial Sequence: Synthetic coding sequence
MAASRLPPATLTLKQFVRRQQVLLLYRRILQTIRQVPNDSDRKYLKDWAREEFRRNKSATEEDTIRMMITQGNMQLKELEKTLALAKS

SEQ ID NO: 11231 - protein, 90 aa, Artificial Sequence
  Description of Artificial Sequence: Synthetic coding sequence
MKMANSLRGEVLKLYKNLLYLGRDYPKGADYFKKRLKNIFLKNKDVKNPEKIKELIAQGEFVMKELEALYFLRKYRAMKQRYYSDTNKTN

SEQ ID NO: 11232 - protein, 34 aa, Artificial Sequence
  Description of Artificial Sequence: Synthetic coding sequence
MANSLRGEVLKLYKNLLYLGRDYPKGADYFKKRL

SEQ ID NO: 11233 - protein, 88 aa, Artificial Sequence
  Description of Artificial Sequence: Synthetic coding sequence
MANSLRGEVLKLYKNLLYLGRDYPKGADYFKKRLKNIFLKNKDVKNPEKIKELIAQGEFVMKELEALYFLRKYRAMKQRYYSDTNKTN

SEQ ID NO: 11234 - protein, 88 aa, Artificial Sequence; identical to SEQ ID NO: 11233
  Description of Artificial Sequence: Synthetic coding sequence

SEQ ID NO: 11235 - protein, 88 aa, Artificial Sequence; identical to SEQ ID NO: 11233
  Description of Artificial Sequence: Synthetic coding sequence

SEQ ID NO: 11236 - protein, 88 aa, Artificial Sequence; identical to SEQ ID NO: 11233
  Description of Artificial Sequence: Synthetic coding sequence

SEQ ID NO: 11237 - protein, 104 aa, Artificial Sequence
  Description of Artificial Sequence: Synthetic coding sequence
MGRAVKVLQLFKTLHRTRQQVFKNDARALEAARIKINEEFKNNKSETSSKKIEELMKIGSDVELLLRTSVIQGIHTDHNTLKLVPRKDLLVENVPYCDAPTQKQ

SEQ ID NO: 11238 - protein, 306 aa, Artificial Sequence
  Description of Artificial Sequence: Synthetic coding sequence
MAGRHQNRSFPLPGVQSSGQVHAFGNCSDSDILEEDAEVYELRSRGKEKVRRSTSRDRLDDIIVLTKDIQEGDTLNAIALQYCCTVADIKRVNNLISDQDFFALRSIKIPVKKFSSLTETLCPPKGRQTSRHSSVQYSSEQQEILPANDSLAYSDSAGSFLKEVDRDIEQIVKCTDNKRENLNEVVSALTAQQMRFEPDNKNTQRKDPYYGADWGIGWWTAVVIMLIVGIITPVFYLLYYEILAKVDVSHHSTVDSSHLHSKITPPSQQREMENGIVPTKGIHFSQQDDHKLYSQDSQSPAAQQET

SEQ ID NO: 11239 - protein, 306 aa, Artificial Sequence; identical to SEQ ID NO: 11238
  Description of Artificial Sequence: Synthetic coding sequence

SEQ ID NO: 11240 - protein, 127 aa, Artificial Sequence
  Description of Artificial Sequence: Synthetic coding sequence
MAGRHQNRSFPLPGVQSSGQVHAFGNCSDSDILEEDAEVYELRSRGKEKVRRSTSRDRLDDIIVLTKDIQEGDTLNAIALQYCCTVYQNSSKKVQFLDRNTLSSKRKTDFTSFICSILFRTTGNFAS

SEQ ID NO: 11241 - protein, 296 aa, Artificial Sequence
  Description of Artificial Sequence: Synthetic coding sequence
MRHEELLTKTFQGPAVVCGTPTSHVYMFKNGSGDSGDSSEEESHRVVLRPRGKERHKSGVHQPPQAGAGDVVLLQRELAQEDSLNKLALQYGCKVADIKKVNNFIREQDLYALKSVKIPVRNHGILMETHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 11242 - protein, 297 aa, Artificial Sequence
  Description of Artificial Sequence: Synthetic coding sequence
MAVGTRGTLLKKSLTVWFCGPGARSATRAVSTSLPRREQVTWCCCSGSWPRRTASTSWRCSMAANTFYFRPNGAGDTRQNLIPDFYAFRVINNGKVADIKKVNNFIREQDLYALKSVKIPVRNHGILMETHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 11243 - protein, 296 aa, Artificial Sequence; identical to SEQ ID NO: 11241
  Description of Artificial Sequence: Synthetic coding sequence

SEQ ID NO: 11244 - protein, 170 aa, Artificial Sequence
  Description of Artificial Sequence: Synthetic coding sequence
METHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 11245 - protein, 544 aa, Artificial Sequence
  Description of Artificial Sequence: Synthetic coding sequence
MSRCAQAAEVAATVPGAGVGNVGLRPPMVPRQASFFPPPVPNPFVQQTQIGSARRVQIVLLGIILLPIRVLLVALILLLAWPFAAISTVCCPEKLTHPITGWRRKITQTALKFLGRAMFFSMGFIVAVKGKIASPLEAPVFVAAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLDTVTWTWQGYTFIQLCMLTFCQLFTKVEVEFMPVQVPNDEEKNDPVLFANKVRNLMAEALGIPVTDHTYEDCRLMISAGQLTLPMEAGLVEFTKISRKLKLDWDGVRKHLDEYASIASSSKGGRIGIEEFAKYLKLPVSDVLRQLFALFDRNHDGSIDFREYVIGLAVLCNPSNTEEIIQVAFKLFDVDEDGYITEEEFSTILQASLGVPDLDVSGLFKEIAQGDSISYEEFKSFALKHPEYAKIFTTYLDLQTCHVFSLPKEVQTTPSTASNKVSPEKHEESTSDKKDD

SEQ ID NO: 11246 - protein, 370 aa, Artificial Sequence
  Description of Artificial Sequence: Synthetic coding sequence
MAITLEEAPWLGWLLVKALMRFAFMVVNNLVAIPSYICYVIILQPLRVLDSKRFWYIEGIMYKWLLGMVASWGWYAGYTVMEWGEDIKAVSKDEAVMLVNHQATGDVCTLMMCLQDKGLVVAQMMWLMDHIFKYTNFGIVSLVHGDFFIRQGRSYRDQQLLLLKKHLENNYRSRDRKWIVLFPEGGFLRKRRETSQAFAKKNNLPFLTNVTLPRSGATKIILNALVAQQKNGSPAGGDAKELDSKSKGLQWIIDTTIAYPKAEPIDIQTWILGYRKPTVTHVHYRIFPIKDVPLETDDLTTWLYQRFVEKEDLLSHFYETGAFPPSKGHKEAVSREMTLSNLWIFLIQSFAFLSGYMWYNIIQYFYHCLF

SEQ ID NO: 11247 - protein, 370 aa, Artificial Sequence; identical to SEQ ID NO: 11246
  Description of Artificial Sequence: Synthetic coding sequence

SEQ ID NO: 11248 - protein, 233 aa, Artificial Sequence
  Description of Artificial Sequence: Synthetic coding sequence
MVSMSFKRNRSDRFYSTRCCGCCHVRTGTIILGTWYMVVNLLMAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLDQLPDFPYKDDLLALDSSCLLFIVLVFFALFIIFKAYLINCVWNCYKYINNRNVPEIAVYPAFEAPPQYVLPTYEMAVKMPEKEPPPPYLPA

SEQ ID NO: 11249 - protein, 416 aa, Artificial Sequence
  Description of Artificial Sequence: Synthetic coding sequence
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 11250 - protein, 180 aa, Artificial Sequence
  Description of Artificial Sequence: Synthetic coding sequence
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKST

SEQ ID NO: 11251 - protein, 280 aa, Artificial Sequence
  Description of Artificial Sequence: Synthetic coding sequence
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 11252 - protein, 236 aa, Artificial Sequence
  Description of Artificial Sequence: Synthetic coding sequence
MDLQGRGVPSIDRLRVLLMLFHTMAQIMAEQEVENLSGLSTNPEKDIFVVRENGTTCLMAEFAAKFIVPYDVWASNYVDESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 11253 - protein, 325 aa, Artificial Sequence
  Description of Artificial Sequence: Synthetic coding sequence
MSLQSRLSGRLAQLRAAGQLLVPPRPRPGHLAGATRTRSSTCGPPAFLGVFGRRARTSAGVGAWGAAAVGRTAGVRTWAPLAMAAKVDLSTSTDWKEAKSFLKGLSDKQREEHYFCKDFVRLKKIPTWKEMAKGVAVKVEEPRYKKDKQLNEKISLLRSDITKLEVDAIVNAANSSLLGGGGVDGCIHRAAGPLLTDECRTLQSCKTGKAKITGGYRLPAKYVIHTVGPIAYGEPSASQAAELRSCYLSSLDLLLEHRLRSVAFPCISTGVFGYPCEAAAEIVLATLREWLEQHKDKVDRLIICVFLEKDEDIYRSRLPHYFPVA

SEQ ID NO: 11254 - protein, 716 aa, Artificial Sequence
  Description of Artificial Sequence: Synthetic coding sequence
MNNFRATILFWAAAAWAKSGKPSGEMDEVGVQKCKNALKLPVLEVLPGGGWDNLRNVDMGRVMELTYSNCRTTEDGQYIIPDEIFTIPQKQSNLEMNSEILESWANYQSSTSYSINTELSLFSKVNGKFSTEFQRMKTLQVKDQAITTRVQVRNLVYTVKINPTLELSSGFRKELLDISDRLENNQTRMATYLAELLVLNYGTHVTTSVDAGAALIQEDHLRASFLQDSQSSRSAVTASAGLAFQNTVNFKFEENYTSQNVLTKSYLSNRTNSRVQSIGGVPFYPGITLQAWQQGITNHLVAIDRSGLPLHFFINPNMLPDLPGPLVKKVSKTVETAVKRYYTFNTYPGCTDLNSPNFNFQANTDDGSCEGKMTNFSFGGVYQECTQLSGNRDVLLCQKLEQKNPLTGDFSCPSGYSPVHLLSQIHEEGYNHLECHRKCTLLVFCKTVCEDVFQVAKAEFRAFWCVASSQVPENSGLLFGGLFSSKSINPMTNAQSCPAGYFPLRLFENLKVCVSQDYELGSRFAVPFGGFFSCTVGNPLVDPAISRDLGAPSLKKCPGGFSQHPALISDGCQVSYCVKSGLFTGGSLPPARLPPFTRPPLMSQAATNTVIVTNSENARSWIKDSQTHQWRLGEPIELRRAMNVIHGDGGGLSGGAAAGVTVGVTTILAVVITLAIYGTRKFKKKAYQAIEERQSLVPGTAATGDTTYQEQGQSPA

SEQ ID NO: 11255 - protein, 164 aa, Artificial Sequence
  Description of Artificial Sequence: Synthetic coding sequence
MNNFRATILFWAAAAWAKSGKPSGEMDEVGVQKCKNALKLPVLEVLPGGGWDNLRNVDMGRVMELTYSNCRTTEDGQYIIPDEIFTIPQKQSNLEMNSEILESWANYQSSTSYSINTELSLFSKVNGKFSTEFQRVPAPCQAPTFHPATPHESGCHQYCHSDQF

SEQ ID NO: 11256 - protein, 465 aa, Artificial Sequence
  Description of Artificial Sequence: Synthetic coding sequence
MEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGITCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 11257 - protein, 253 aa, Artificial Sequence
  Description of Artificial Sequence: Synthetic coding sequence
MEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGSTVNMNLMGWLYSKIEALLGSAGHTTLGITLMIGGITCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGK

SEQ ID NO: 11258 - protein, 475 aa, Artificial Sequence
  Description of Artificial Sequence: Synthetic coding sequence
MGVALRDLPGRHVSSRSHVTAVLTVFHGRCFLPGFGVVTTFPSPSPAGAMEEEDEEARALLAGGPDEADRGAPAAPGALPALCDPSRLAHRLLVLLLMCFLGFAIFAMIILLPFRLKLNEWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGITCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 11259 - protein, 514 aa, Artificial Sequence
  Description of Artificial Sequence: Synthetic coding sequence
MGVALRDLPGRHVSSRSHVTAVLTVFHGRCFLPGFGVVTTFPSPSPAGAMEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGITCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 11260 - protein, 455 aa, Artificial Sequence
  Description of Artificial Sequence: Synthetic coding sequence
MGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASVYWLAGAQACFTTWSGLFLLPFFLLQKLSYPAQTLKAE

SEQ ID NO: 11261 - protein, 455 aa, Artificial Sequence; identical to SEQ ID NO: 11260
  Description of Artificial Sequence: Synthetic coding sequence

SEQ ID NO: 11262 - protein, 449 aa, Artificial Sequence
  Description of Artificial Sequence: Synthetic coding sequence
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAVLWTAQGNCLTINSDEHSIGRNSGIFWALLQSSLFFGNLYIYFAWQGKTQISESDRRTVFIALTVISLVGTVLFFLIRKPDSENVLGEDESSDDQDMEVNESAQNNLTKAVDAFKKSFKLCVTKEMLLLSITTAYTGLELTFFSGVYGTCIGATNKFGAEEKSLIGLSGIFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQSICAAVAFFYSNYLLLHWQLLVMVIFGFFGTISFFTVEWEAAAFVARGSDYRSI

SEQ ID NO: 11263 - protein, 397 aa, Artificial Sequence
  Description of Artificial Sequence: Synthetic coding sequence
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAESDRRTVFIALTVISLVGTVLFFLIRKPDSENVLGEDESSDDQDMEVNESAQNNLTKAVDAFKKSFKLCVTKEMLLLSITTAYTGLELTFFSGVYGTCIGATNKFGAEEKSLIGLSGIFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQSICAAVAFFYSNYLLLHWQLLVMVIFGFFGTISFFTVEWEAAAFVARGSDYRSI

SEQ ID NO: 11264 - protein, 480 aa, Artificial Sequence
  Description of Artificial Sequence: Synthetic coding sequence
MGPGPPAAGAAPSPRPLSLVARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRWDRDARP

SEQ ID NO: 11265 - protein, 473 aa, Artificial Sequence
  Description of Artificial Sequence: Synthetic coding sequence
MGPGPPAAGAAPSPRPLSLVARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRR

SEQ ID NO: 11266 - protein, 538 aa, Artificial Sequence
  Description of Artificial Sequence: Synthetic coding sequence
MGPGPPAAGAAPSPRPLSLVARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRSFLAWRRGRGEDKGPGYSWIPTVLVQPPRPTSPFLWEAPLAWRCTRKKWSGAGTKPWPREDWGTH

SEQ ID NO: 11267 - protein, 412 aa, Artificial Sequence
  Description of Artificial Sequence: Synthetic coding sequence
MRGKLLPLAGLYLVQGLPYGLQSGLLPVLLRAGGLSLTRVGLAKVLYAPWLLKLAWAPLVDAQGSARAWVTRSTAGLGLVCGLLAGLPPPGAGQAGLPAAVAGLLLLLNLGAAMQDVALDALAVQLLEPAELGPGNTVQVVAYKLGAALAGGALLALLPTFSWPQLFLLLAATYWLAAALAWAAPALRRLPQQPPSEQRPHTAHLLRDVLAVPGTVWTAGFVLTYKLGEQGASSLFPLLLLDHGVSAPELGLWNGVGAVVCSIAGSSLGGTLLAKHWKLLPLLRSVLRFRLGGLACQTALVFHLDTLGASMDAGTILRGSALLSLCLQHFLGGLVTTVTFTGMMRCSQLAPRALQATHYSLLATLELLGKLLLGTLAGGLADGLGPHPCFLLLLILSAFPVLYLDLAPSTFL

SEQ ID NO: 11268 - protein, 514 aa, Artificial Sequence
  Description of Artificial Sequence: Synthetic coding sequence
MGCDGRVSGLLRRNLQPTLTYWSVFFSFGLCIAFLGPTLLDLRCQTHSSLPQISWVFFSQQLCLLLGSALGGVFKRTLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLPVPMAVLMLLSKERLLTCCPQRRPLLLSADELALETQPPEKEDASSLPPKFQSHLGHEDLFSCCQRKNLRGAPYSFFAIHITGALVLFMTDGLTGAYSAFVYSYAVEKPLSVGHKVAGYLPSLFWGFITLGRLLSIPISSRMKPATMVFINVVGVVVTFLVLLIFSYNVVFLFVGTASLGLFLSSTFPSMLAYTEDSLQYKGCATTVLVTGAGVGEMVLQMLVGSIFQAQGSYSFLVCGVIFGCLAFTFYILLLFFHRMHPGLPSVPTQDRSIGMENSECYQR

SEQ ID NO: 11269 - protein, 427 aa, Artificial Sequence
  Description of Artificial Sequence: Synthetic coding sequence
MGCDGRVSGLLRRNLQPTLTYWSVFFSFGLCIAFLGPTLLDLRCQTHSSLPQISWVFFSQQLCLLLGSALGGVFKRTLAQSLWALFTSSLAISLVFAVIPFCRDVKVLASVMALAGLAMGCIDTVANMQLVRMYQKDSAVFLQLPVPMAVLMLLSKERLLTCCPQRRPLLLSADELALETQPPEKEDASSLPPKFQSHLGHEDLFSCCQRKNLRGAPYSFFAIHITGALVLFMTDGLTGAYSAFVYSYAVEKPLSVGHKVAGYLPSLFWGFITLGRLLSIPISSRMKPATMVFINVVGVVVTFLVLLIFSYNVVFLFVGTASLGLFLSSTFPSMLAYTEDSLQYKGCATTVLVTGAGVGEMVLQMLVGSIFQAQGSYSFLVCGVIFGCLAFTFYILLLFFHRMHPGLPSVPTQDRSIGMENSECYQR

SEQ ID NO: 11270 - protein, 440 aa, Artificial Sequence
  Description of Artificial Sequence: Synthetic coding sequence
MGCDGRVSGLLRRNLQPTLTYWSVFFSFGLCIAFLGPTLLDLRCQTHSSLPQISWVFFSQQLCLLLGSALGGVFKRTLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLPVPMAVLMLLSKERLLTCCPQRRPLLLSADELALETQPPEKEDASSLPPKFQSHLGHEDLFSCCQRKNLRGAPYSFFAIHITGALVLFMTDGLTGAYSAFVYSYAVEKPLSVGHKVAGYLPSLFWGFITLGRLLSIPISSRMKPATMVFINVVGVVVTFLVLLIFSYNVVFLFVGTASLGLFLSSTFPSMLAYTEDSLQYKDIPGSGQL

SEQ ID NO: 11271 - protein, 432 aa, Artificial Sequence
  Description of Artificial Sequence: Synthetic coding sequence
MEVTAVGEEANQGDLLGFGQRCCSLGSSNPWLYRTAGIFPEHCTEEKKIGTYFRVAPQASKSQRSRCHGMAASEARPGEATAASYGRPFPTHPRRQEFRARVVRGPTMLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRTVIEKQALGICSAFALLSW

SEQ ID NO: 11272 - protein, 450 aa, Artificial Sequence
  Description of Artificial Sequence: Synthetic coding sequence
MLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 11273 - protein, 557 aa, Artificial Sequence
  Description of Artificial Sequence: Synthetic coding sequence
MEVTAVGEEANQGDLLGFGQRCCSLGSSNPWLYRTAGIFPEHCTEEKKIGTYFRVAPQASKSQRSRCHGMAASEARPGEATAASYGRPFPTHPRRQEFRARVVRGPTMLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 11274 - protein, 464 aa, Artificial Sequence
  Description of Artificial Sequence: Synthetic coding sequence
MEVTAVGEEANQGDLLGFGQRCCSLGSSNPWLYRTAGIFPEHCTEEKKIGTYFRVAPQASKSQRSRCHGMAASEARPGEATAASYGRPFPTHPRRQEFRARVVRGPTMLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKSDRKTGTRNMFSICSAVMVMALLAVVGLFTVVRHDAELRVPSPTEEPYAPEL

SEQ ID NO: 11275 - protein, 586 aa, Artificial Sequence
  Description of Artificial Sequence: Synthetic coding sequence
MSANPRWDISRALGVAKLFHLVCGVREACVTPFLTLYLRQLGLAAPWVGTLMGTKHLIAAFWAPVCAFLAKSYRKRRALLIGSLLGSVGASLLMVLVPPVDKNRVHFPCNGSSGLTSTDALPGVTLPVNITSAQESASSHPAKRTAEVEMPGFRNPPGESDRETFRDLHVYLAPSVEGARTTSQALLHPVTSGLKDHPWEVTFEVVKTALPLLPGGKGPGNPANLSGTKGKAWAFDLSLEALRRTFILSLGSVAFWELLTAPLEQVADDSLYEFLDFVDATDRYRSLWVWRLLGMSAGVCGITALVGQLDCFLMTSGPRGVVHFYGYSVVSTLALLVSIAFPIPICQQWEPSYKRVKALSIVGGDPHLILLASTTVLVGAIVSTVQNFLFWHMKDHGSGELVMGFSVALSLLGEILLHPFKATLLRKLSRTGLVGLGLSCLAGQLLYYSFLWSWWSVLPIQILSAISNRALWWAVGASVEDLATPRMERALSALFRGHFYGSGCSLGSFVGGFVVMRFSLAVLYQACCVALLLWLALLLSIQRRLPRERKIKYSKLLSMEVSDTSDSEQGTEQDWLVKAMREEHSD

SEQ ID NO: 11276 - protein, 559 aa, Artificial Sequence
  Description of Artificial Sequence: Synthetic coding sequence
MAGPTEAETGLAEPRALCAQRGHRTYARRWVFLLAISLLNCSNATLWLSFAPVADVIAEDLVLSMEQINWLSLVYLVVSTPFGVAAIWILDSVGLRAATILGAWLNFAGSVLRMVPCMVVGTQNPFAFLMGGQSLCALAQSLVIFSPAKLAALWFPEHQRATANMLATMSNPLGVLVANVLSPVLVKKGEDIPLMLGVYTIPAGVVCLLSTICLWESVPPTPPSAGAASSTSEKFLDGLKLLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 11277 - protein, 441 aa, Artificial Sequence
  Description of Artificial Sequence: Synthetic coding sequence
MAGPTEAETGLAEPRALCAQRGHRTYARRWVFLLAISLLNCSNATINWLSLVYLVVSTPFGVAAIWILDSVGLRAALGVYTIPAGVVCLLSTICLWESVPPTPPSAGAASSTSEKFLDGLKLQLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 11278 - protein, 560 aa, Artificial Sequence
  Description of Artificial Sequence: Synthetic coding sequence
MAGPTEAETGLAEPRALCAQRGHRTYARRWVFLLAISLLNCSNATLWLSFAPVADVIAEDLVLSMEQINWLSLVYLVVSTPFGVAAIWILDSVGLRAATILGAWLNFAGSVLRMVPCMVVGTQNPFAFLMGGQSLCALAQSLVIFSPAKLAALWFPEHQRATANMLATMSNPLGVLVANVLSPVLVKKGEDIPLMLGVYTIPAGVVCLLSTICLWESVPPTPPSAGAASSTSEKFLDGLKLQLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 11279 - protein, 474 aa, Artificial Sequence
  Description of Artificial Sequence: Synthetic coding sequence
MELGGHWDMNSAPRLVSETAERKQEQKTGTEAEAADSGAVGARRFLLCLYLVGFLDLFGVSMVVPLLSLHVKSLGASPTVAGIVGSSYGILQLFSSTLVGCWSDVVGRRSSLLACILLSALGYLLLGAATNVFLFVLARVPAGIFKHTLSISRALLSDVVPEKERPLVIGHFNTASGVGFILGPVVGGYLTELEDGFYLTAFICFLVFILNAGLVWFFPWREAKPGSTEKGLPLRKTHVLLGRSHDTVQEAATSRRARASKKTAQPWVEVVLALRNMKNLLFSEMWDIFLVRLLMAMAVMLYYSNFVLALEERFGVRPKVTGYLISYSSMLGAVAGLALGPILRLYKHNSQALLLHSSILTCTLLLLYSLAPTMGAVVLSSTLLSFSTAIGRTCITDLQLTVGGAQASGTLIGVGQSVTAVGRIIAPLLSGVAQEVSPCGPPSLGAVLALVAIFIMSLNKRHSSGDGNSKLKSE

SEQ ID NO: 11280 - protein, 154 aa, Artificial Sequence
  Description of Artificial Sequence: Synthetic coding sequence
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRLRSPSASGRRPMRRSS

SEQ ID NO: 11281 - protein, 299 aa, Artificial Sequence
  Description of Artificial Sequence: Synthetic coding sequence
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWV

SEQ ID NO: 11282 - protein, 371 aa, Artificial Sequence
  Description of Artificial Sequence: Synthetic coding sequence
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSGGEGVKDRKGGSYTQAASSDSAQGSDVSLTACKV

SEQ ID NO: 11283 - protein, 365 aa, Artificial Sequence
  Description of Artificial Sequence: Synthetic coding sequence
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 11284 - protein, 299 aa, Artificial Sequence
  Description of Artificial Sequence: Synthetic coding sequence
MAVMAPRTLVLLLSGALALTQTWAGSHSMRYFYTSVSRPGRGEPRFIAVGYVDDTQFVRFDSDAASQRMEPRAPWIEQEGPEYWDRNTRNVKAHSQTDRANLGTLRGYYNQSEDGSHTIQRMYGCDVGPDGRFLRGYQQDAYDGKDYIALNEDLRSWTAADMAAQITQRKWETAHEAEQWRAYLEGRCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWV

SEQ ID NO: 11285 - protein, 365 aa, Artificial Sequence
  Description of Artificial Sequence: Synthetic coding sequence
MAVMAPRTLVLLLSGALALTQTWAGSHSMRYFYTSVSRPGRGEPRFIAVGYVDDTQFVRFDSDAASQRMEPRAPWIEQEGPEYWDRNTRNVKAHSQTDRANLGTLRGYYNQSEDGSHTIQRMYGCDVGPDGRFLRGYQQDAYDGKDYIALNEDLRSWTAADMAAQITQRKWETAHEAEQWRAYLEGRCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVIAGAVVAAVMWRRKSSDRKGGSYSQAASSDSAQGSDMSLTACKV

SEQ ID NO: 11286 - protein, 371 aa, Artificial Sequence
  Description of Artificial Sequence: Synthetic coding sequence
MAVMAPRTLVLLLSGALALTQTWAGSHSMRYFYTSVSRPGRGEPRFIAVGYVDDTQFVRFDSDAASQRMEPRAPWIEQEGPEYWDRNTRNVKAHSQTDRANLGTLRGYYNQSEDGSHTIQRMYGCDVGPDGRFLRGYQQDAYDGKDYIALNEDLRSWTAADMAAQITQRKWETAHEAEQWRAYLEGRCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVIAGAVVAAVMWRRKSSGGEGMKDRKGGSYSQAASSDSAQGSDMSLTACKV

SEQ ID NO: 11287 - protein, 365 aa, Artificial Sequence; identical to SEQ ID NO: 11283
  Description of Artificial Sequence: Synthetic coding sequence

SEQ ID NO: 11288 - protein, 299 aa, Artificial Sequence
  Description of Artificial Sequence: Synthetic coding sequence
  MOD_RES (1)..(1): Any amino acid
XAVMAPRTLVLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWV

SEQ ID NO: 11289 - protein, 299 aa, Artificial Sequence
  Description of Artificial Sequence: Synthetic coding sequence
MAVMAPRTLLLLLLGALALTQTWAGSHSMRYFFTSVSRPGRGEPRFIAVGYVDDTQFVRFDSDAASQRMEPRAPWIEQEGPEYWDQETRNVKAHSQTDRESLRIALRYYNQSEAGSHTIQMMYGCDVGPDGRLLRGYQQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWV

SEQ ID NO: 11290 - protein, 299 aa, Artificial Sequence
  Description of Artificial Sequence: Synthetic coding sequence
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWV

SEQ ID NO: 11291 - protein, 371 aa, Artificial Sequence
  Description of Artificial Sequence: Synthetic coding sequence
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSGGEGVKDRKGGSYTQAASSDSAQGSDVSLTACKV

SEQ ID NO: 11292 - protein, 365 aa, Artificial Sequence
  Description of Artificial Sequence: Synthetic coding sequence
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 11293 - protein, 371 aa, Artificial Sequence
  Description of Artificial Sequence: Synthetic coding sequence
MAVMAPRTLVLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEPSSQPTIPIVGIIAGLVLFGAVITGAVVAAVMWRRKSSGGEGVKDRKGGSYSQAASSDSAQGSDVSLTACKV

SEQ ID NO: 11294 - protein, 299 aa, Artificial Sequence; identical to SEQ ID NO: 11290
  Description of Artificial Sequence: Synthetic coding sequence

SEQ ID NO: 11295 - protein, 365 aa, Artificial Sequence; identical to SEQ ID NO: 11292
  Description of Artificial Sequence: Synthetic coding sequence

SEQ ID NO: 11296 - protein, 371 aa, Artificial Sequence; identical to SEQ ID NO: 11291
  Description of Artificial Sequence: Synthetic coding sequence

SEQ ID NO: 11297 - protein, 299 aa, Artificial Sequence
  Description of Artificial Sequence: Synthetic coding sequence
MAVMAPRTLLLLLLGALALTQTWAGSHSMRYFTTSVSRPGRGEPRFIAVGYVDDTQFVRFDSDAASQRMEPRAPWIEQEGPEYWDLQTRNVKAQSQTDRANLGTLRGYYNQSEAGSHTIQMMYGCDVGSDGRFLRGYRQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWV

SEQ ID NO: 11298 - protein, 365 aa, Artificial Sequence
  Description of Artificial Sequence: Synthetic coding sequence
  MOD_RES (1)..(1): Any amino acid
XAVMAPRTLVLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEPSSQPTIPIVGIIAGLVLFGAVITGAVVAAVMWRRKSSDRKGGSYSQAASSDSAQGSDVSLTACKV

SEQ ID NO: 11299 - protein, 299 aa, Artificial Sequence
  Description of Artificial Sequence: Synthetic coding sequence
MAVMAPRTLVLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWV

SEQ ID NO: 11300 - protein, 365 aa, Artificial Sequence
  Description of Artificial Sequence: Synthetic coding sequence
MAVMAPRTLLLLLLGALALTQTWAGSHSMRYFFTSVSRPGRGEPRFIAVGYVDDTQFVRFDSDAASQRMEPRAPWIEQEGPEYWDQETRNVKAHSQTDRESLRIALRYYNQSEAGSHTIQMMYGCDVGPDGRLLRGYQQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAMFAGAVVAAVRWRRKSSDRKGGSYSQAASSDSAQGSDMSLTACKV

SEQ ID NO: 11301 - protein, 371 aa, Artificial Sequence
  Description of Artificial Sequence: Synthetic coding sequence
  MOD_RES (1)..(1): Any amino acid
XAVMAPRTLVLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEPSSQPTIPIVGIIAGLVLFGAVITGAVVAAVMWRRKSSGGEGVKDRKGGSYSQAASSDSAQGSDVSLTACKV

SEQ ID NO: 11302 - protein, 365 aa, Artificial Sequence
  Description of Artificial Sequence: Synthetic coding sequence
MAVMAPRTLLLLLLGALALTQTWAGSHSMRYFTTSVSRPGRGEPRFIAVGYVDDTQFVRFDSDAASQRMEPRAPWIEQEGPEYWDLQTRNVKAQSQTDRANLGTLRGYYNQSEAGSHTIQMMYGCDVGSDGRFLRGYRQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVFAGAVVAAVRWRRKSSDRKGGSYSQAASSDSAQGSDMSLTACKV

SEQ ID NO: 11303 - protein, 365 aa, Artificial Sequence [sequence omitted]

SEQ ID NO: 11304 - protein, 342 aa, Artificial Sequence
  Description of Artificial Sequence: Synthetic coding sequence
MAVMAPRTLLLLLLGALALTQTWAGSHSMRYFTTSVSRPGRGEPRFIAVGYVDDTQFVRFDSDAASQRMEPRAPWIEQEGPEYWDLQTRNVKAQSQTDRANLGTLRGYYNQSEAGSHTIQMMYGCDVGSDGRFLRGYRQDAYDGKDYIALNEDLRSWTAADMAAQITQRKWEAARVAEQLRAYLEGTCVEWLRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVFAGAVVAAVRWRRKSSGGVKG

SEQ ID NO: 11305 - protein, 114 aa, Artificial Sequence
  Description of Artificial Sequence: Synthetic coding sequence
MTHHPISDHEATLRCWALGFYPAEITLTWQRDGEDQTQDTELVETRPAGDGTFQKWAAVVVPSGEEQRYTCHVQHEGLPKPLTLRWDRKGGSYTQAASSDSAQGSDVSLTACKV

SEQ ID NO: 11306 - protein, 154 aa, Artificial Sequence
  Description of Artificial Sequence: Synthetic coding sequence
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRLRSPSASGRRSMRRSS

SEQ ID NO: 11307 - protein, 365 aa, Artificial Sequence [sequence omitted]

SEQ ID NO: 11308 - protein, 362 aa, Artificial Sequence
  Description of Artificial Sequence: Synthetic coding sequence
MAPRTLLLLLSGALALTQTWAGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEPSSQPTIPIVGIIAGLVLFGAVITGAVVAAVMWRRKSSDRKGGSYSQAASSDSAQGSDVSLTACKV

SEQ ID NO: 11309 - protein, 365 aa, Artificial Sequence; identical to SEQ ID NO: 11285
  Description of Artificial Sequence: Synthetic coding sequence

SEQ ID NO: 11310 - protein, 295 aa, Artificial Sequence
  Description of Artificial Sequence: Synthetic coding sequence
MAVMAPRTLLLLLLGALALTQTWAGSHSMRYFTTSVSRPGRGEPRFIAVGYVDDTQFVRFDSDAASQRMEPRAPWIEQEGPEYWDLQTRNVKAQSQTDRAYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVFAGAVVAAVRWRRKSSGGEGMKGGSEISCLTEGSKTQVEVCPASLLGSTIHNYGPTQPGPCVPALTLL

SEQ ID NO: 11311 - protein, 365 aa, Artificial Sequence; identical to SEQ ID NO: 11292
  Description of Artificial Sequence: Synthetic coding sequence

SEQ ID NO: 11312 - protein, 295 aa, Artificial Sequence
  Description of Artificial Sequence: Synthetic coding sequence
MAVMAPRTLLLLLLGALALTQTWAGSHSMRYFFTSVSRPGRGEPRFIAVGYVDDTQFVRFDSDAASQRMEPRAPWIEQEGPEYWDQETRNVKAHSQTDRRYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAMFAGAVVAAVRWRRKSSGGEGMKGGSEISCLTEGSKTQVEVCPASLLGSTIHNYGPTQPGPCVPALTLL

SEQ ID NO: 11313 - protein, 365 aa, Artificial Sequence; identical to SEQ ID NO: 11302
  Description of Artificial Sequence: Synthetic coding sequence

SEQ ID NO: 11314 - protein, 114 aa, Artificial Sequence; identical to SEQ ID NO: 11305
  Description of Artificial Sequence: Synthetic coding sequence

SEQ ID NO: 11315 - protein, 295 aa, Artificial Sequence
  Description of Artificial Sequence: Synthetic coding sequence
MAVMAPRTLVLLLSGALALTQTWAGSHSMRYFYTSVSRPGRGEPRFIAVGYVDDTQFVRFDSDAASQRMEPRAPWIEQEGPEYWDRNTRNVKAHSQTDRAYLENGKETLQRTDAPKTHMTHHAVSDHEATLRCWALSFYPAEITLTWQRDGEDQTQDTELVETRPAGDGTFQKWASVVVPSGQEQRYTCHVQHEGLPKPLTLRWEPSSQPTIPIVGIIAGLVLFGAVIAGAVVAAVMWRRKSSGGEGMKGGSEISCLTEGSKTQVEVCPASLLGSTIHNYEPTQPGPCVPALTLL

SEQ ID NO: 11316 - protein, 154 aa, Artificial Sequence; identical to SEQ ID NO: 11306
  Description of Artificial Sequence: Synthetic coding sequence

SEQ ID NO: 11317 - protein, 365 aa, Artificial Sequence; identical to SEQ ID NO: 11292
  Description of Artificial Sequence: Synthetic coding sequence

SEQ ID NO: 11318 - protein, 365 aa, Artificial Sequence; identical to SEQ ID NO: 11300
  Description of Artificial Sequence: Synthetic coding sequence

SEQ ID NO: 11319 - protein, 114 aa, Artificial Sequence; identical to SEQ ID NO: 11305
  Description of Artificial Sequence: Synthetic coding sequence

SEQ ID NO: 11320 - protein, 362 aa, Artificial Sequence
  Description of Artificial Sequence: Synthetic coding sequence
MRVTAPRTLLLLLWGAVALTETWAGSHSMRYFHTSVSRPGRGEPRFISVGYVDGTQFVRFDSDAASPRTEPRAPWIEQEGPEYWDRNTQISKTNTQTYRESLRNLRGYYNQSEAGSHTLQRMYGCDVGPDGRLLRGHDQSAYDGKDYIALNEDLSSWTAADTAAQITQRKWEAARVAEQLRAYLEGTCVEWLRRHLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGGKGGSYSQAASSDSAQGSDVSLTA

SEQ ID NO: 11321 - protein, 362 aa, Artificial Sequence
  Description of Artificial Sequence: Synthetic coding sequence
MLVMAPRTVLLLLSAALALTETWAGSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 11322 - protein, 241 aa, Artificial Sequence
  Description of Artificial Sequence: Synthetic coding sequence
  MOD_RES (1)..(1): Any amino acid
XPDGRLLRGHNQYAYDGKDYIALNEDLRSWTAADTAAQITQRKWEAARVAEQDRAYLEGTCVEWLRRYLENGKDTLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGHFLPTGGKGGSYSQAACSDSAQGSDVSLTA

SEQ ID NO: 11323 - protein, 241 aa, Artificial Sequence
  Description of Artificial Sequence: Synthetic coding sequence
  MOD_RES (1)..(1): Any amino acid
XPDGRLLRGHDQSAYDGKDYIALNEDLSSWTAADTAAQITQRKWEAARVAEQLRAYLEGTCVEWLRRHLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGHFLPTGGKGGSYSQAASSDSAQGSDVSLTA

SEQ ID NO: 11324 - protein, 362 aa, Artificial Sequence
  Description of Artificial Sequence: Synthetic coding sequence
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQDRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 11325 - protein, 241 aa, Artificial Sequence
  Description of Artificial Sequence: Synthetic coding sequence
  MOD_RES (1)..(1): Any amino acid
XPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGHFLPTGGKGGSYSQAASSDSAQGSDVSLTA

SEQ ID NO: 11326 - protein, 362 aa, Artificial Sequence
  Description of Artificial Sequence: Synthetic coding sequence
MLVMAPRTVLLLLSAALALTETWAGSHSMRYFDTAMSRPGRGEPRFISVGYVDDTQFVRFDSDAASPREEPRAPWIEQEGPEYWDRNTQIFKTNTQTDRESLRNLRGYYNQSEAGSHTLQSMYGCDVGPDGRLLRGHNQYAYDGKDYIALNEDLRSWTAADTAAQITQRKWEAARVAEQDRAYLEGTCVEWLRRYLENGKDTLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 11327 - protein, 225 aa, Artificial Sequence
  Description of Artificial Sequence: Synthetic coding sequence
  MOD_RES (1)..(1): Any amino acid
XMLVMAPRTVLLLLSAALALTETWAGSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADQEQKSLFPAQRLELSNE

SEQ ID NO: 11328 - protein, 241 aa, Artificial Sequence
  Description of Artificial Sequence: Synthetic coding sequence
MYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 11329 - protein, 246 aa, Artificial Sequence
  Description of Artificial Sequence: Synthetic coding sequence
MASVGRREGTAGGGAGPGEPRREEGRAGLSPSSPPGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQLRAYLEGLCVESLRRYLENGKETLQRADPPKTHVTHHPISDHEVTLRCWALGFYPA

SEQ ID NO: 11330 - protein, 246 aa, Artificial Sequence
  Description of Artificial Sequence: Synthetic coding sequence
MASAGRSEGTAGGGAGPEEPRREEGRAGLSPSSPPGSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPA

SEQ ID NO: 11331 - protein, 362 aa, Artificial Sequence
  Description of Artificial Sequence: Synthetic coding sequence
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQLRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 11332 - protein, 241 aa, Artificial Sequence
  Description of Artificial Sequence: Synthetic coding sequence
  MOD_RES (1)..(1): Any amino acid
XPDGRLLRGYDQDAYDGKDYIALNEDLSSWTAADTAAQITQRKWEAARVAEQLRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGHFLPTGGKGGSYSQAACSDSAQGSDVSLTA

SEQ ID NO: 11333 - protein, 241 aa, Artificial Sequence
  Description of Artificial Sequence: Synthetic coding sequence
  MOD_RES (1)..(1): Any amino acid
XPDGRLLRGYDQDAYDGKDYIALNEDLSSWTAADTAAQITQRKWEAARVAEQDRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGHFLPTGGKGGSYSQAACSDSAQGSDVSLTA

SEQ ID NO: 11334 - protein, 246 aa, Artificial Sequence
  Description of Artificial Sequence: Synthetic coding sequence
MASVGRSEGTAGGGAGPGEPRREEGRAGLSPSSPPGSHSMRYFYTAMSRPGRGEPRFIAVGYVDDTQFVRFDSDAASPRMAPRAPWIEQEGPEYWDRETQISKTNTQTYRESLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPA

SEQ ID NO: 11335 - protein, 246 aa, Artificial Sequence
  Description of Artificial Sequence: Synthetic coding sequence
MASAGRSEGTAGGGAGPEEPRREEGRAGLSPSSPPGSHSMRYFDTAMSRPGRGEPRFISVGYVDDTQFVRFDSDAASPREEPRAPWIEQEGPEYWDRNTQIFKTNTQTDRESLRNLRGYYNQSEAGSHTLQSMYGCDVGPDGRLLRGHNQYAYDGKDYIALNEDLRSWTAADTAAQITQRKWEAARVAEQDRAYLEGTCVEWLRRYLENGKDTLERADPPKTHVTHHPISDHEATLRCWALGFYPA

SEQ ID NO: 11336 - protein, 246 aa, Artificial Sequence
  Description of Artificial Sequence: Synthetic coding sequence
MASVGRREGTAGGGAGPGEPRREEGRAGLSPSSPPGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQDRAYLEGLCVESLRRYLENGKETLQRADPPKTHVTHHPISDHEVTLRCWALGFYPA

SEQ ID NO: 11337 - protein, 362 aa, Artificial Sequence
  Description of Artificial Sequence: Synthetic coding sequence
MRVTAPRTVLLLLSGALALTETWAGSHSMRYFYTAMSRPGRGEPRFIAVGYVDDTQFVRFDSDAASPRMAPRAPWIEQEGPEYWDRETQISKTNTQTYRESLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTIPIVGIVAGLAVLAVVVIGAVVATVMCRRKSSGGKGGSYSQAASSDSAQGSDVSLTA

SEQ ID NO: 11338 - protein, 202 aa, Artificial Sequence
  Description of Artificial Sequence: Synthetic coding sequence
MYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWGGKGGSYSQAACSDSAQGSDVSLTA

SEQ ID NO: 11339 - protein, 224 aa, Artificial Sequence
  Description of Artificial Sequence: Synthetic coding sequence
MLVMAPRTVLLLLSAALALTETWAGSHSMRYFDTAMSRPGRGEPRFISVGYVDDTQFVRFDSDAASPREEPRAPWIEQEGPEYWDRNTQIFKTNTQTDRESLRNLRGYYNQSEAGSHTLQSMYGCDVGPDGRLLRGHNQYAYDGKDYIALNEDLRSWTAADTAAQITQRKWEAARVAEQDRAYLEGTCVEWLRRYLENGKDTLERADQEQKSLFPAQRLELSNE

SEQ ID NO: 11340 - protein, 224 aa, Artificial Sequence
  Description of Artificial Sequence: Synthetic coding sequence
MRVTAPRTVLLLLSGALALTETWAGSHSMRYFYTAMSRPGRGEPRFIAVGYVDDTQFVRFDSDAASPRMAPRAPWIEQEGPEYWDRETQISKTNTQTYRESLRNLRGYYNQSEAGSHTLQRMYGCDVGPDGRLLRGHDQSAYDGKDYIALNEDLSSWTAADTAAQITQRKWEAAREAEQWRAYLEGLCVEWLRRYLENGKETLQRADQEQKSLFPAQRLELSNE

SEQ ID NO: 11341 - protein, 224 aa, Artificial Sequence
  Description of Artificial Sequence: Synthetic coding sequence
MRVTAPRTLLLLLWGAVALTETWAGSHSMRYFHTSVSRPGRGEPRFISVGYVDGTQFVRFDSDAASPRTEPRAPWIEQEGPEYWDRNTQISKTNTQTYRESLRNLRGYYNQSEAGSHTLQRMYGCDVGPDGRLLRGHDQSAYDGKDYIALNEDLSSWTAADTAAQITQRKWEAARVAEQLRAYLEGTCVEWLRRHLENGKETLQRADQEQKSLFPAQRLELSNE

SEQ ID NO: 11342 - protein, 224 aa, Artificial Sequence
  Description of Artificial Sequence: Synthetic coding sequence
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQLRAYLEGLCVESLRRYLENGKETLQRADQEQKSLFPAQRLELSNE

SEQ ID NO: 11343 - protein, 224 aa, Artificial Sequence
  Description of Artificial Sequence: Synthetic coding sequence
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQDRAYLEGLCVESLRRYLENGKETLQRADQEQKSLFPAQRLELSNE

SEQ ID NO: 11344 - protein, 433 aa, Artificial Sequence
  Description of Artificial Sequence: Synthetic coding sequence
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNPGRRSRLPIPHVRPGSPRVSGSEIRPRGRGTRPDPRPARAPGAFTRFHFQLRPKSPRVGRGGAGLGTGLTAGPGPGSHIIQRMYGCDVGPDGRLLRGYDQDAYDGKDYIALNEDLSSWTAADTAAQITQRKWEAARVAEQLRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 11345 - protein, 241 aa, Artificial Sequence
  Description of Artificial Sequence: Synthetic coding sequence
MYGCDVGPDGRLLRGHNQYAYDGKDYIALNEDLRSWTAADTAAQITQRKWEAARVAEQDRAYLEGTCVEWLRRYLENGKDTLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 11346 - protein, 433 aa, Artificial Sequence
  Description of Artificial Sequence: Synthetic coding sequence
MRVTAPRTLLLLLWGAVALTETWAGSHSMRYFYTAMSRPGRGEPRFITVGYVDDTLFVRFDSDATSPRKEPRAPWIEQEGPEYWDRETQISKTNTQTYRENLRTALRYYNPGRRSRLPIPHVRPGSPRVSGSEIRPRGRGTRPDPRPARAPGAFTRFHFQLRPKSPRVGRGGAGLGTGLTAGPGPGSHIIQRMYGCDVGPDGRLLRGYDQDAYDGKDYIALNEDLSSWTAADTAAQITQRKWEAARVAEQDRAYLEGLCVESLRRYLENGKETLQRADPPKTHVTHHPISDHEVTLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 11347 - protein, 358 aa, Artificial Sequence
  Description of Artificial Sequence: Synthetic coding sequence
MVDGTLLLLLSEALALTQTWAGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDGRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 11348 - protein, 358 aa, Artificial Sequence [sequence omitted]

SEQ ID NO: 11349 - protein, 358 aa, Artificial Sequence [sequence omitted]

SEQ ID NO: 11350 - protein, 358 aa, Artificial Sequence [sequence omitted]

SEQ ID NO: 11351 - protein, 358 aa, Artificial Sequence; identical to SEQ ID NO: 11347
  Description of Artificial Sequence: Synthetic coding sequence

SEQ ID NO: 11352 - protein, 358 aa, Artificial Sequence [sequence omitted]

SEQ ID NO: 11353 - protein, 358 aa, Artificial Sequence; identical to SEQ ID NO: 11347
  Description of Artificial Sequence: Synthetic coding sequence

SEQ ID NO: 11354 - protein, 399 aa, Artificial Sequence
  Description of Artificial Sequence: Synthetic coding sequence
MEPSFYSSRRPWPLPRPGRVSAGSGWKRPLPGVERGRPGGGEGLGEPRREEGRADLSPSSPPGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDRRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 11355 - protein, 442 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 11356 - protein, 346 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSDRNRGSYSQAAV

SEQ ID NO: 11357 - protein, 346 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAV

SEQ ID NO: 11358 - protein, 254 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRAEQSPQPTIPIVGIVAGLVVLGAVVTGAVVAAVMWRKKSSDRNRGSYSQAAV

SEQ ID NO: 11359 - protein, 334 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSS

SEQ ID NO: 11360 - protein, 254 aa, Artificial Sequence; identical to SEQ ID NO: 11358
  Description of Artificial Sequence: Synthetic coding sequence

SEQ ID NO: 11361 - protein, 346 aa, Artificial Sequence; identical to SEQ ID NO: 11356
  Description of Artificial Sequence: Synthetic coding sequence

SEQ ID NO: 11362 - protein, 254 aa, Artificial Sequence; identical to SEQ ID NO: 11358
  Description of Artificial Sequence: Synthetic coding sequence

SEQ ID NO: 11363 - protein, 442 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 11364 - protein, 346 aa, Artificial Sequence; identical to SEQ ID NO: 11357
  Description of Artificial Sequence: Synthetic coding sequence

SEQ ID NO: 11365 - protein, 442 aa, Artificial Sequence; identical to SEQ ID NO: 11363
  Description of Artificial Sequence: Synthetic coding sequence

SEQ ID NO: 11366 - protein, 349 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKAQLLSVSTSQTSILIQEQFSHQRTLAMSGKMFCCHDWSEEEVLPASCGE

SEQ ID NO: 11367 - protein, 131 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLL

SEQ ID NO: 11368 - protein, 131 aa, Artificial Sequence; identical to SEQ ID NO: 11367
  Description of Artificial Sequence: Synthetic coding sequence

SEQ ID NO: 11369 - protein, 131 aa, Artificial Sequence; identical to SEQ ID NO: 11367
  Description of Artificial Sequence: Synthetic coding sequence

SEQ ID NO: 11370 - protein, 213 aa, Artificial Sequence
  Description of Artificial Sequence: Synthetic coding sequence
  MOD_RES (1)..(1): Any amino acid
XPDPPPGRVPGAFTEHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSS

SEQ ID NO: 11371 - protein, 254 aa, Artificial Sequence; identical to SEQ ID NO: 11358
  Description of Artificial Sequence: Synthetic coding sequence

SEQ ID NO: 11372 - protein, 131 aa, Artificial Sequence; identical to SEQ ID NO: 11367
  Description of Artificial Sequence: Synthetic coding sequence

SEQ ID NO: 11373 - protein, 225 aa, Artificial Sequence
  Description of Artificial Sequence: Synthetic coding sequence
  MOD_RES (1)..(1): Any amino acid
XPDPPPGRVPGAFTEHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAV

SEQ ID NO: 11374 - protein, 334 aa, Artificial Sequence; identical to SEQ ID NO: 11359
  Description of Artificial Sequence: Synthetic coding sequence

SEQ ID NO: 11375 - protein, 346 aa, Artificial Sequence; identical to SEQ ID NO: 11357
  Description of Artificial Sequence: Synthetic coding sequence

SEQ ID NO: 11376 - protein, 124 aa, Artificial Sequence
  Description of Artificial Sequence: Synthetic coding sequence
  MOD_RES (1)..(1): Any amino acid
XAVMWRKKSSGHFLPIDRNRGSYSQAAAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 11377 - protein, 124 aa, Artificial Sequence; identical to SEQ ID NO: 11376
  Description of Artificial Sequence: Synthetic coding sequence
  MOD_RES (1)..(1): Any amino acid

SEQ ID NO: 11378 - protein, 225 aa, Artificial Sequence; identical to SEQ ID NO: 11373
  Description of Artificial Sequence: Synthetic coding sequence
  MOD_RES (1)..(1): Any amino acid

SEQ ID NO: 11379 - protein, 442 aa, Artificial Sequence; identical to SEQ ID NO: 11363
  Description of Artificial Sequence: Synthetic coding sequence

SEQ ID NO: 11380 - protein, 225 aa, Artificial Sequence
  Description of Artificial Sequence: Synthetic coding sequence
  MOD_RES (1)..(1): Any amino acid
XPDPPPGRVPGAFTQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSDRNRGSYSQAAV

SEQ ID NO: 11381 - protein, 442 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAAYSVVSGLLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 11382 - protein, 225 aa, Artificial Sequence; identical to SEQ ID NO: 11373
  Description of Artificial Sequence: Synthetic coding sequence
  MOD_RES (1)..(1): Any amino acid

SEQ ID NO: 11383 - protein, 254 aa, Artificial Sequence; identical to SEQ ID NO: 11358
  Description of Artificial Sequence: Synthetic coding sequence

SEQ ID NO: 11384 - protein, 346 aa, Artificial Sequence; identical to SEQ ID NO: 11357
  Description of Artificial Sequence: Synthetic coding sequence

SEQ ID NO: 11385 - protein, 131 aa, Artificial Sequence; identical to SEQ ID NO: 11367
  Description of Artificial Sequence: Synthetic coding sequence

SEQ ID NO: 11386 - protein, 10 aa, Artificial Sequence
  Description of Artificial Sequence: Synthetic coding sequence
  MOD_RES (1)..(1): Any amino acid
XAVMWRKKSS

SEQ ID NO: 11387 - protein, 259 aa, Artificial Sequence
  Description of Artificial Sequence: Synthetic coding sequence
MNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSAYSVVSGNLMITWWSSLFLLGVLFQGYLGCLRSHSVLGRRKHF

SEQ ID NO: 11388 - protein, 254 aa, Artificial Sequence; identical to SEQ ID NO: 11358
  Description of Artificial Sequence: Synthetic coding sequence

SEQ ID NO: 11389 - protein, 242 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRAEQSPQPTIPIVGIVAGLVVLGAVVTGAVVAAVMWRKKSS

SEQ ID NO: 11390 - protein, 131 aa, Artificial Sequence; identical to SEQ ID NO: 11367
  Description of Artificial Sequence: Synthetic coding sequence

SEQ ID NO: 11391 - protein, 124 aa, Artificial Sequence; identical to SEQ ID NO: 11376
  Description of Artificial Sequence: Synthetic coding sequence
  MOD_RES (1)..(1): Any amino acid

SEQ ID NO: 11392 - protein, 346 aa, Artificial Sequence; identical to SEQ ID NO: 11357
  Description of Artificial Sequence: Synthetic coding sequence

SEQ ID NO: 11393 - protein, 442 aa, Artificial Sequence; identical to SEQ ID NO: 11363
  Description of Artificial Sequence: Synthetic coding sequence

SEQ ID NO: 11394 - protein, 131 aa, Artificial Sequence; identical to SEQ ID NO: 11367
  Description of Artificial Sequence: Synthetic coding sequence

SEQ ID NO: 11395 - protein, 124 aa, Artificial Sequence
  Description of Artificial Sequence: Synthetic coding sequence
  MOD_RES (1)..(1): Any amino acid
XAVMWRKKSSGHFLPIDRNRGSYSQAAAYSVVSGLLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 11396 - protein, 419 aa, Artificial Sequence
  Description of Artificial Sequence: Synthetic coding sequence
MAPRSLLLLLSGALALTDTWAGSHSLRYFSTAVSRPGRGEPRYIAVEPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 11397 - protein, 124 aa, Artificial Sequence; identical to SEQ ID NO: 11376
  Description of Artificial Sequence: Synthetic coding sequence
  MOD_RES (1)..(1): Any amino acid

SEQ ID NO: 11398 - protein, 225 aa, Artificial Sequence
  Description of Artificial Sequence: Synthetic coding sequence
  MOD_RES (1)..(1): Any amino acid
XPDPPPGRVPGAFTQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAV

SEQ ID NO: 11399 - protein, 225 aa, Artificial Sequence; identical to SEQ ID NO: 11398
  Description of Artificial Sequence: Synthetic coding sequence
  MOD_RES (1)..(1): Any amino acid

SEQ ID NO: 11400 - protein, 124 aa, Artificial Sequence; identical to SEQ ID NO: 11376
  Description of Artificial Sequence: Synthetic coding sequence
  MOD_RES (1)..(1): Any amino acid

SEQ ID NO: 11401 - protein, 259 aa, Artificial Sequence [sequence omitted]

SEQ ID NO: 11402 - protein, 349 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKAQLLSVSTSQTSILIQEQFSHQRTLAMSGKMFCCHDWSEEKVLPASCGE

SEQ ID NO: 11403 - protein, 419 aa, Artificial Sequence
  Description of Artificial Sequence: Synthetic coding sequence
MAPRSLLLLLSGALALTDTWAGSHSLRYFSTAVSRPGRGEPRYIAVEPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 11404 - protein, 349 aa, Artificial Sequence; identical to SEQ ID NO: 11402
  Description of Artificial Sequence: Synthetic coding sequence

SEQ ID NO: 11405 - protein, 259 aa, Artificial Sequence
  Description of Artificial Sequence: Synthetic coding sequence
MNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSAYSVVSGNLMITWWSSLFLLGVLFQGYLGCLRSHSVLGRRKHF

SEQ ID NO: 11406 - protein, 259 aa, Artificial Sequence; identical to SEQ ID NO: 11405
  Description of Artificial Sequence: Synthetic coding sequence

SEQ ID NO: 11407 - protein, 419 aa, Artificial Sequence; identical to SEQ ID NO: 11403
  Description of Artificial Sequence: Synthetic coding sequence

SEQ ID NO: 11408 - protein, 349 aa, Artificial Sequence; identical to SEQ ID NO: 11402
  Description of Artificial Sequence: Synthetic coding sequence

SEQ ID NO: 11409 - protein, 435 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAAYSVVSGLLMITWWSSLFLLGVLFQGYLGCLRSHSVLGRRKAQLLSVSTSQTSILIQEQFSHQRTLAMSGKMFCCHDWSEEEVLPASCGE

SEQ ID NO: 11410 - protein, 346 aa, Artificial Sequence; identical to SEQ ID NO: 11357
  Description of Artificial Sequence: Synthetic coding sequence

SEQ ID NO: 11411 - protein, 259 aa, Artificial Sequence; identical to SEQ ID NO: 11405
  Description of Artificial Sequence: Synthetic coding sequence

SEQ ID NO: 11412 - protein, 346 aa, Artificial Sequence; identical to SEQ ID NO: 11357
  Description of Artificial Sequence: Synthetic coding sequence

SEQ ID NO: 11413 - protein, 349 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKAQLLSVSTSQTSILIQEQFSHQRTLAMSGKMFCCHDWSEEEVLPASCGE

SEQ ID NO: 11414 - protein, 419 aa, Artificial Sequence; identical to SEQ ID NO: 11403
  Description of Artificial Sequence: Synthetic coding sequence

SEQ ID NO: 11415 - protein, 259 aa, Artificial Sequence; identical to SEQ ID NO: 11405
  Description of Artificial Sequence: Synthetic coding sequence

SEQ ID NO: 11416 - protein, 419 aa, Artificial Sequence; identical to SEQ ID NO: 11403
  Description of Artificial Sequence: Synthetic coding sequence

SEQ ID NO: 11417 - protein, 346 aa, Artificial Sequence; identical to SEQ ID NO: 11357
  Description of Artificial Sequence: Synthetic coding sequence

SEQ ID NO: 11418 - protein, 346 aa, Artificial Sequence; identical to SEQ ID NO: 11357
  Description of Artificial Sequence: Synthetic coding sequence

SEQ ID NO: 11419 - protein, 338 aa, Artificial Sequence
  Description of Artificial Sequence: Synthetic coding sequence
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSGRKG

SEQ ID NO: 11420 - protein, 419 aa, Artificial Sequence
  Description of Artificial Sequence: Synthetic coding sequence
MAPRSLLLLLSGALALTDTWAGSHSLRYFSTAVSRPGRGEPRYIAVEPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAAYSVVSGLLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 11421 - protein, 338 aa, Artificial Sequence
  Description of Artificial Sequence: Synthetic coding sequence
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 11422 - protein, 154 aa, Artificial Sequence
  Description of Artificial Sequence: Synthetic coding sequence
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEAKQSSLPTIPIMGIVAGLVVLAAVVTGAAVAAVLWRKKSSD

SEQ ID NO: 11423 - protein, 246 aa, Artificial Sequence
  Description of Artificial Sequence: Synthetic coding sequence
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEANPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 11424 - protein, 343 aa, Artificial Sequence
  Description of Artificial Sequence: Synthetic coding sequence
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 11425 - protein, 338 aa, Artificial Sequence; identical to SEQ ID NO: 11421
  Description of Artificial Sequence: Synthetic coding sequence

SEQ ID NO: 11426 - protein, 154 aa, Artificial Sequence; identical to SEQ ID NO: 11422
  Description of Artificial Sequence: Synthetic coding sequence

SEQ ID NO: 11427 - protein, 246 aa, Artificial Sequence; identical to SEQ ID NO: 11423
  Description of Artificial Sequence: Synthetic coding sequence

SEQ ID NO: 11428 - protein, 343 aa, Artificial Sequence; identical to SEQ ID NO: 11424
  Description of Artificial Sequence: Synthetic coding sequence

SEQ ID NO: 11429 - protein, 343 aa, Artificial Sequence; identical to SEQ ID NO: 11424
  Description of Artificial Sequence: Synthetic coding sequence

SEQ ID NO: 11430 - protein, 246 aa, Artificial Sequence; identical to SEQ ID NO: 11423
  Description of Artificial Sequence: Synthetic coding sequence

SEQ ID NO: 11431 - protein, 154 aa, Artificial Sequence; identical to SEQ ID NO: 11422
  Description of Artificial Sequence: Synthetic coding sequence

SEQ ID NO: 11432 - protein, 343 aa, Artificial Sequence; identical to SEQ ID NO: 11424
  Description of Artificial Sequence: Synthetic coding sequence

SEQ ID NO: 11433 - protein, 343 aa, Artificial Sequence; identical to SEQ ID NO: 11424
  Description of Artificial Sequence: Synthetic coding sequence

SEQ ID NO: 11434 - protein, 338 aa, Artificial Sequence; identical to SEQ ID NO: 11421
  Description of Artificial Sequence: Synthetic coding sequence

SEQ ID NO: 11435 - protein, 338 aa, Artificial Sequence; identical to SEQ ID NO: 11421
  Description of Artificial Sequence: Synthetic coding sequence

SEQ ID NO: 11436 - protein, 246 aa, Artificial Sequence; identical to SEQ ID NO: 11423
  Description of Artificial Sequence: Synthetic coding sequence

SEQ ID NO: 11437 - protein, 338 aa, Artificial Sequence; identical to SEQ ID NO: 11421
  Description of Artificial Sequence: Synthetic coding sequence

SEQ ID NO: 11438 - protein, 338 aa, Artificial Sequence; identical to SEQ ID NO: 11421
  Description of Artificial Sequence: Synthetic coding sequence

SEQ ID NO: 11439 - protein, 154 aa, Artificial Sequence; identical to SEQ ID NO: 11422
  Description of Artificial Sequence: Synthetic coding sequence

SEQ ID NO: 11440 - protein, 246 aa, Artificial Sequence; identical to SEQ ID NO: 11423
  Description of Artificial Sequence: Synthetic coding sequence

SEQ ID NO: 11441 - protein, 343 aa, Artificial Sequence; identical to SEQ ID NO: 11424
  Description of Artificial Sequence: Synthetic coding sequence

SEQ ID NO: 11442 - protein, 246 aa, Artificial Sequence; identical to SEQ ID NO: 11423
  Description of Artificial Sequence: Synthetic coding sequence

SEQ ID NO: 11443 - protein, 338 aa, Artificial Sequence; identical to SEQ ID NO: 11421
  Description of Artificial Sequence: Synthetic coding sequence

SEQ ID NO: 11444 - protein, 154 aa, Artificial Sequence; identical to SEQ ID NO: 11422
  Description of Artificial Sequence: Synthetic coding sequence

SEQ ID NO: 11445 - protein, 154 aa, Artificial Sequence; identical to SEQ ID NO: 11422
  Description of Artificial Sequence: Synthetic coding sequence

SEQ ID NO: 11446 - protein, 338 aa, Artificial Sequence; identical to SEQ ID NO: 11421
  Description of Artificial Sequence: Synthetic coding sequence

SEQ ID NO: 11447 - protein, 343 aa, Artificial Sequence; identical to SEQ ID NO: 11424
  Description of Artificial Sequence: Synthetic coding sequence

SEQ ID NO: 11448 - protein, 246 aa, Artificial Sequence; identical to SEQ ID NO: 11423
  Description of Artificial Sequence: Synthetic coding sequence

SEQ ID NO: 11449 - protein, 246 aa, Artificial Sequence; identical to SEQ ID NO: 11423
  Description of Artificial Sequence: Synthetic coding sequence

SEQ ID NO: 11450 - protein, 154 aa, Artificial Sequence; identical to SEQ ID NO: 11422
  Description of Artificial Sequence: Synthetic coding sequence

SEQ ID NO: 11451 - protein, 246 aa, Artificial Sequence; identical to SEQ ID NO: 11423
  Description of Artificial Sequence: Synthetic coding sequence

SEQ ID NO: 11452 - protein, 246 aa, Artificial Sequence; identical to SEQ ID NO: 11423
  Description of Artificial Sequence: Synthetic coding sequence

SEQ ID NO: 11453 - protein, 246 aa, Artificial Sequence; identical to SEQ ID NO: 11423
  Description of Artificial Sequence: Synthetic coding sequence

SEQ ID NO: 11454 - protein, 246 aa, Artificial Sequence; identical to SEQ ID NO: 11423
  Description of Artificial Sequence: Synthetic coding sequence

SEQ ID NO: 11455 - protein, 246 aa, Artificial Sequence; identical to SEQ ID NO: 11423
  Description of Artificial Sequence: Synthetic coding sequence

SEQ ID NO: 11456 - protein, 246 aa, Artificial Sequence; identical to SEQ ID NO: 11423
  Description of Artificial Sequence: Synthetic coding sequence

SEQ ID NO: 11457 - protein, 338 aa, Artificial Sequence; identical to SEQ ID NO: 11421
  Description of Artificial Sequence: Synthetic coding sequence

SEQ ID NO: 11458 - protein, 338 aa, Artificial Sequence; identical to SEQ ID NO: 11421
  Description of Artificial Sequence: Synthetic coding sequence

SEQ ID NO: 11459 - protein, 338 aa, Artificial Sequence; identical to SEQ ID NO: 11421
  Description of Artificial Sequence: Synthetic coding sequence

SEQ ID NO: 11460 - protein, 338 aa, Artificial Sequence; identical to SEQ ID NO: 11421
  Description of Artificial Sequence: Synthetic coding sequence

SEQ ID NO: 11461 - protein, 338 aa, Artificial Sequence; identical to SEQ ID NO: 11421
  Description of Artificial Sequence: Synthetic coding sequence

SEQ ID NO: 11462 - protein, 338 aa, Artificial Sequence; identical to SEQ ID NO: 11421
  Description of Artificial Sequence: Synthetic coding sequence

SEQ ID NO: 11463 - protein, 123 aa, Artificial Sequence [sequence omitted]

SEQ ID NO: 11464 - protein, 261 aa, Artificial Sequence
  Description of Artificial Sequence: Synthetic coding sequence
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 11465 - protein, 227 aa, Artificial Sequence
  Description of Artificial Sequence: Synthetic coding sequence
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 11466 - protein, 166 aa, Artificial Sequence
  Description of Artificial Sequence: Synthetic coding sequence
MGHEQNQGAALLQMLPLLWLLPHSWAVPEGFPIAEVFTLKPLEFGKPNTLVCFVSNLFPPMLTVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 11467 - protein, 261 aa, Artificial Sequence; identical to SEQ ID NO: 11464
  Description of Artificial Sequence: Synthetic coding sequence

SEQ ID NO: 11468 - protein, 227 aa, Artificial Sequence; identical to SEQ ID NO: 11465
  Description of Artificial Sequence: Synthetic coding sequence

SEQ ID NO: 11469 - protein, 166 aa, Artificial Sequence; identical to SEQ ID NO: 11466
  Description of Artificial Sequence: Synthetic coding sequence

SEQ ID NO: 11470 - protein, 241 aa, Artificial Sequence
  Description of Artificial Sequence: Synthetic coding sequence
MKWLKKCLDTAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSG

SEQ ID NO: 11471 - protein, 169 aa, Artificial Sequence
  Description of Artificial Sequence: Synthetic coding sequence
MWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSVPVEGFGPTFVSAVDGLSFQAFSYLNFTPEPSDIFSC

SEQ ID NO: 11472 - protein, 290 aa, Artificial Sequence
  Description of Artificial Sequence: Synthetic coding sequence
VSCWLSDSCQELQRRGIILCSYGVTSPIAVFGRPGRLRNRRHFERRLVPMKWLKKCLDTAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSG

SEQ ID NO: 11473 - protein, 169 aa, Artificial Sequence; identical to SEQ ID NO: 11471
  Description of Artificial Sequence: Synthetic coding sequence

SEQ ID NO: 11474 - protein, 227 aa, Artificial Sequence; identical to SEQ ID NO: 11465
  Description of Artificial Sequence: Synthetic coding sequence

SEQ ID NO: 11475 - protein, 169 aa, Artificial Sequence; identical to SEQ ID NO: 11471
  Description of Artificial Sequence: Synthetic coding sequence

SEQ ID NO: 11476 - protein, 166 aa, Artificial Sequence; identical to SEQ ID NO: 11466
  Description of Artificial Sequence: Synthetic coding sequence

SEQ ID NO: 11477 - protein, 227 aa, Artificial Sequence
  Description of Artificial Sequence: Synthetic coding sequence
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRVNWQHHSIPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 11478 - protein, 290 aa, Artificial Sequence; identical to SEQ ID NO: 11472
  Description of Artificial Sequence: Synthetic coding sequence

SEQ ID NO: 11479 - protein, 169 aa, Artificial Sequence; identical to SEQ ID NO: 11471
  Description of Artificial Sequence: Synthetic coding sequence

SEQ ID NO: 11480 - protein, 169 aa, Artificial Sequence; identical to SEQ ID NO: 11471
  Description of Artificial Sequence: Synthetic coding sequence

SEQ ID NO: 11481 - protein, 227 aa, Artificial Sequence; identical to SEQ ID NO: 11465
  Description of Artificial Sequence: Synthetic coding sequence

SEQ ID NO: 11482 - protein, 290 aa, Artificial Sequence; identical to SEQ ID NO: 11472
  Description of Artificial Sequence: Synthetic coding sequence

SEQ ID NO: 11483 - protein, 261 aa, Artificial Sequence; identical to SEQ ID NO: 11464
  Description of Artificial Sequence: Synthetic coding sequence

SEQ ID NO: 11484 - protein, 166 aa, Artificial Sequence; identical to SEQ ID NO: 11466
  Description of Artificial Sequence: Synthetic coding sequence

SEQ ID NO: 11485 - protein, 169 aa, Artificial Sequence; identical to SEQ ID NO: 11471
  Description of Artificial Sequence: Synthetic coding sequence

SEQ ID NO: 11486 - protein, 261 aa, Artificial Sequence
  Description of Artificial Sequence: Synthetic coding sequence
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSIPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 11487 - protein, 290 aa, Artificial Sequence; identical to SEQ ID NO: 11472
  Description of Artificial Sequence: Synthetic coding sequence

SEQ ID NO: 11488 - protein, 169 aa, Artificial Sequence
  Description of Artificial Sequence: Synthetic coding sequence
MWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSIPVEGFGPTFVSAVDGLSFQAFSYLNFTPEPSDIFSC

SEQ ID NO: 11489 - protein, 261 aa, Artificial Sequence; identical to SEQ ID NO: 11464
  Description of Artificial Sequence: Synthetic coding sequence

SEQ ID NO: 11490 - protein, 166 aa, Artificial Sequence
  Description of Artificial Sequence: Synthetic coding sequence
MGHEQNQGAALLQMLPLLWLLPHSWAVPEGFPIAEVFTLKPLEFGKPNTLVCFVSNLFPPMLTVNWQHHSIPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 11491 - protein, 261 aa, Artificial Sequence; identical to SEQ ID NO: 11464
  Description of Artificial Sequence: Synthetic coding sequence

SEQ ID NO: 11492 - protein, 227 aa, Artificial Sequence; identical to SEQ ID NO: 11465
  Description of Artificial Sequence: Synthetic coding sequence

SEQ ID NO: 11493 - protein, 166 aa, Artificial Sequence; identical to SEQ ID NO: 11466
  Description of Artificial Sequence: Synthetic coding sequence

SEQ ID NO: 11494 - protein, 227 aa, Artificial Sequence; identical to SEQ ID NO: 11465
  Description of Artificial Sequence: Synthetic coding sequence

SEQ ID NO: 11495 - protein, 227 aa, Artificial Sequence; identical to SEQ ID NO: 11465
  Description of Artificial Sequence: Synthetic coding sequence

SEQ ID NO: 11496 - protein, 261 aa, Artificial Sequence; identical to SEQ ID NO: 11464
  Description of Artificial Sequence: Synthetic coding sequence

SEQ ID NO: 11497 - protein, 166 aa, Artificial Sequence; identical to SEQ ID NO: 11466
  Description of Artificial Sequence: Synthetic coding sequence

SEQ ID NO: 11498 - protein, 261 aa, Artificial Sequence; identical to SEQ ID NO: 11464
  Description of Artificial Sequence: Synthetic coding sequence

SEQ ID NO: 11499 - protein, 290 aa, Artificial Sequence; identical to SEQ ID NO: 11472
  Description of Artificial Sequence: Synthetic coding sequence

SEQ ID NO: 11500 - protein, 290 aa, Artificial Sequence
  Description of Artificial Sequence: Synthetic coding sequence
VSCWLSDSCQELQRRGIILCSYGVTSPIAVFGRPGRLRNRRHFERRLVPMKWLKKCLDTAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLKPLEFGKPNTLVCFVSNLFPPMLTVNWQHHSIPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSG

SEQ ID NO: 11501 - protein, 290 aa, Artificial Sequence; identical to SEQ ID NO: 11472
  Description of Artificial Sequence: Synthetic coding sequence

SEQ ID NO: 11502 - protein, 166 aa, Artificial Sequence; identical to SEQ ID NO: 11466
  Description of Artificial Sequence: Synthetic coding sequence

SEQ ID NO: 11503 - protein, 169 aa, Artificial Sequence; identical to SEQ ID NO: 11471
  Description of Artificial Sequence: Synthetic coding sequence

SEQ ID NO: 11504 - protein, 263 aa, Artificial Sequence
  Description of Artificial Sequence: Synthetic coding sequence
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSYTPLPGSNYSEGWHIS

SEQ ID NO: 11505 - protein, 263 aa, Artificial Sequence; identical to SEQ ID NO: 11504
  Description of Artificial Sequence: Synthetic coding sequence

SEQ ID NO: 11506 - protein, 263 aa, Artificial Sequence
  Description of Artificial Sequence: Synthetic coding sequence
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHTGAPEPILRDWTPGLSPMQTLKVSVSAVTLGLGLIIFSLGVISWRRAGHSSYTPLPGSNYSEGWHIS

SEQ ID NO: 11507 - protein, 141 aa, Artificial Sequence
  Description of Artificial Sequence: Synthetic coding sequence
  MOD_RES (1)..(1): Any amino acid
XTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSRWHIS

SEQ ID NO: 11508 - protein, 257 aa, Artificial Sequence
  Description of Artificial Sequence: Synthetic coding sequence
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSDLIISLLFIL

SEQ ID NO: 11509 - protein, 106 aa, Artificial Sequence
  Description of Artificial Sequence: Synthetic coding sequence
VAKTTPFNTREPVMLACYVWGFYPAEVTITWRKNGKLVMPHSSAHKTAQPNGDWTYQTLSHLALTPSYGDTYTCVVEHTGAPEPILRDWSYTPLPGSNYSEGWHIS

SEQ ID NO: 11510 - protein, 141 aa, Artificial Sequence
  Description of Artificial Sequence: Synthetic coding sequence
  MOD_RES (1)..(1): Any amino acid
XTRPPSVQVAKTTPFNTREPVMLACYVWGFYPAEVTITWRKNGKLVMPHSSAHKTAQPNGDWTYQTLSHLALTPSYGDTYTCVVEHTGAPEPILRDWTPGLSPMQTLKVSVSAVTLGLGLIIFSLGVISWRRAGHSRWHIS

SEQ ID NO: 11511 - protein, 175 aa, Artificial Sequence
  Description of Artificial Sequence: Synthetic coding sequence
MGHEQNQGAALLQMLPLLWLLPHSWAVPEEQSMITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPA

SEQ ID NO: 11512 - protein, 175 aa, Artificial Sequence; identical to SEQ ID NO: 11511
  Description of Artificial Sequence: Synthetic coding sequence

SEQ ID NO: 11513 - protein, 216 aa, Artificial Sequence
  Description of Artificial Sequence: Synthetic coding sequence
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHTGAPEPILRDWSKCMADGWN

SEQ ID NO: 11514 - protein, 263 aa, Artificial Sequence; identical to SEQ ID NO: 11506
  Description of Artificial Sequence: Synthetic coding sequence

SEQ ID NO: 11515 - protein, 257 aa, Artificial Sequence
  Description of Artificial Sequence: Synthetic coding sequence
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHTGAPEPILRDWTPGLSPMQTLKVSVSAVTLGLGLIIFSLGVISWRRAGHSSDLIISLLFIL

SEQ ID NO: 11516 - protein, 106 aa, Artificial Sequence
  Description of Artificial Sequence: Synthetic coding sequence
VAKTTPFNTREPVMLACYVWGFYPAEVTITWRKNGKLVMPHSSAHKTAQPNGDWTYQTLSHLALTPSYGDTYTCVVEHIGAPEPILRDWSYTPLPGSNYSEGWHIS

SEQ ID NO: 11517 - protein, 263 aa, Artificial Sequence; identical to SEQ ID NO: 11506
  Description of Artificial Sequence: Synthetic coding sequence

SEQ ID NO: 11518 - protein, 141 aa, Artificial Sequence; identical to SEQ ID NO: 11510
  Description of Artificial Sequence: Synthetic coding sequence
  MOD_RES (1)..(1): Any amino acid

SEQ ID NO: 11519 - protein, 263 aa, Artificial Sequence; identical to SEQ ID NO: 11504
  Description of Artificial Sequence: Synthetic coding sequence

SEQ ID NO: 11520 - protein, 257 aa, Artificial Sequence; identical to SEQ ID NO: 11508
  Description of Artificial Sequence: Synthetic coding sequence

SEQ ID NO: 11521 - protein, 175 aa, Artificial Sequence; identical to SEQ ID NO: 11511
  Description of Artificial Sequence: Synthetic coding sequence

SEQ ID NO: 11522 - protein, 175 aa, Artificial Sequence; identical to SEQ ID NO: 11511
  Description of Artificial Sequence: Synthetic coding sequence

SEQ ID NO: 11523 - protein, 106 aa, Artificial Sequence; identical to SEQ ID NO: 11516
  Description of Artificial Sequence: Synthetic coding sequence

SEQ ID NO: 11524 - protein, 141 aa, Artificial Sequence; identical to SEQ ID NO: 11510
  Description of Artificial Sequence: Synthetic coding sequence
  MOD_RES (1)..(1): Any amino acid

SEQ ID NO: 11525 - protein, 175 aa, Artificial Sequence; identical to SEQ ID NO: 11511
  Description of Artificial Sequence: Synthetic coding sequence

SEQ ID NO: 11526 - protein, 106 aa, Artificial Sequence; identical to SEQ ID NO: 11509
  Description of Artificial Sequence: Synthetic coding sequence

SEQ ID NO: 11527 - protein, 106 aa, Artificial Sequence; identical to SEQ ID NO: 11516
  Description of Artificial Sequence: Synthetic coding sequence

SEQ ID NO: 11528 - protein, 106 aa, Artificial Sequence; identical to SEQ ID NO: 11516
  Description of Artificial Sequence: Synthetic coding sequence

SEQ ID NO: 11529 - protein, 141 aa, Artificial Sequence; identical to SEQ ID NO: 11507
  Description of Artificial Sequence: Synthetic coding sequence
  MOD_RES (1)..(1): Any amino acid

SEQ ID NO: 11530 - protein, 106 aa, Artificial Sequence; identical to SEQ ID NO: 11509
  Description of Artificial Sequence: Synthetic coding sequence

SEQ ID NO: 11531 - protein, 257 aa, Artificial Sequence; identical to SEQ ID NO: 11515
  Description of Artificial Sequence: Synthetic coding sequence

SEQ ID NO: 11532 - protein, 263 aa, Artificial Sequence; identical to SEQ ID NO: 11504
  Description of Artificial Sequence: Synthetic coding sequence

SEQ ID NO: 11533 - protein, 106 aa, Artificial Sequence; identical to SEQ ID NO: 11509
  Description of Artificial Sequence: Synthetic coding sequence

SEQ ID NO: 11534 - protein, 141 aa, Artificial Sequence; identical to SEQ ID NO: 11510
  Description of Artificial Sequence: Synthetic coding sequence
  MOD_RES (1)..(1): Any amino acid

SEQ ID NO: 11535 - protein, 257 aa, Artificial Sequence; identical to SEQ ID NO: 11515
  Description of Artificial Sequence: Synthetic coding sequence

SEQ ID NO: 11536 - protein, 257 aa, Artificial Sequence; identical to SEQ ID NO: 11508
  Description of Artificial Sequence: Synthetic coding sequence

SEQ ID NO: 11537 - protein, 175 aa, Artificial Sequence; identical to SEQ ID NO: 11511
  Description of Artificial Sequence: Synthetic coding sequence

SEQ ID NO: 11538 - protein, 141 aa, Artificial Sequence; identical to SEQ ID NO: 11507
  Description of Artificial Sequence: Synthetic coding sequence
  MOD_RES (1)..(1): Any amino acid

SEQ ID NO: 11539 - protein, 175 aa, Artificial Sequence; identical to SEQ ID NO: 11511
  Description of Artificial Sequence: Synthetic coding sequence

SEQ ID NO: 11540 - protein, 175 aa, Artificial Sequence; identical to SEQ ID NO: 11511
  Description of Artificial Sequence: Synthetic coding sequence

SEQ ID NO: 11541 - protein, 263 aa, Artificial Sequence; identical to SEQ ID NO: 11506
  Description of Artificial Sequence: Synthetic coding sequence

SEQ ID NO: 11542 - protein, 141 aa, Artificial Sequence; identical to SEQ ID NO: 11507
  Description of Artificial Sequence: Synthetic coding sequence
  MOD_RES (1)..(1): Any amino acid

SEQ ID NO: 11543 - protein, 257 aa, Artificial Sequence; identical to SEQ ID NO: 11508
  Description of Artificial Sequence: Synthetic coding sequence

SEQ ID NO: 11544 - protein, 257 aa, Artificial Sequence; identical to SEQ ID NO: 11515
  Description of Artificial Sequence: Synthetic coding sequence

SEQ ID NO: 11545 - protein, 216 aa, Artificial Sequence [sequence omitted]

SEQ ID NO: 11546 - protein, 56 aa, Artificial Sequence
  Description of Artificial Sequence: Synthetic coding sequence
MPHSSAHKTAQPNGDWTYQTLSHLALTPSYGDTYTCVVEHIGAPEPILRDWRWHIS

SEQ ID NO: 11547 - protein, 56 aa, Artificial Sequence; identical to SEQ ID NO: 11546
  Description of Artificial Sequence: Synthetic coding sequence

SEQ ID NO: 11548 - protein, 216 aa, Artificial Sequence; identical to SEQ ID NO: 11513
  Description of Artificial Sequence: Synthetic coding sequence

SEQ ID NO: 11549 - protein, 68 aa, Artificial Sequence
  Description of Artificial Sequence: Synthetic coding sequence
MPHSSAHKTAQPNGDWTYQTLSHLALTPSYGDTYTCVVEHIGAPEPILRDWSYTPLPGSNYSEGWHIS

SEQ ID NO: 11550 - protein, 56 aa, Artificial Sequence; identical to SEQ ID NO: 11546
  Description of Artificial Sequence: Synthetic coding sequence

SEQ ID NO: 11551 - protein, 95 aa, Artificial Sequence
  Description of Artificial Sequence: Synthetic coding sequence
MPHSSAHKTAQPNGDWTYQTLSHLALTPSYGDTYTCVVEHIGAPEPILRDWTPGLSPMQTLKVSVSAVTLGLGLIIFSLGVISWRRAGHSRWHIS

SEQ ID NO: 11552 - protein, 68 aa, Artificial Sequence; identical to SEQ ID NO: 11549
  Description of Artificial Sequence: Synthetic coding sequence

SEQ ID NO: 11553 - protein, 68 aa, Artificial Sequence; identical to SEQ ID NO: 11549
  Description of Artificial Sequence: Synthetic coding sequence

SEQ ID NO: 11554 - protein, 95 aa, Artificial Sequence; identical to SEQ ID NO: 11551
  Description of Artificial Sequence: Synthetic coding sequence

SEQ ID NO: 11555 - protein, 216 aa, Artificial Sequence [sequence omitted]

SEQ ID NO: 11556 - protein, 68 aa, Artificial Sequence; identical to SEQ ID NO: 11549
  Description of Artificial Sequence: Synthetic coding sequence

SEQ ID NO: 11557 - protein, 216 aa, Artificial Sequence; identical to SEQ ID NO: 11513
  Description of Artificial Sequence: Synthetic coding sequence

SEQ ID NO: 11558 - protein, 216 aa, Artificial Sequence; identical to SEQ ID NO: 11513
  Description of Artificial Sequence: Synthetic coding sequence

SEQ ID NO: 11559 - protein, 56 aa, Artificial Sequence; identical to SEQ ID NO: 11546
  Description of Artificial Sequence: Synthetic coding sequence

SEQ ID NO: 11560 - protein, 216 aa, Artificial Sequence [sequence omitted]

SEQ ID NO: 11561 - protein, 95 aa, Artificial Sequence; identical to SEQ ID NO: 11551
  Description of Artificial Sequence: Synthetic coding sequence

SEQ ID NO: 11562 - protein, 95 aa, Artificial Sequence; identical to SEQ ID NO: 11551
  Description of Artificial Sequence: Synthetic coding sequence

SEQ ID NO: 11563 - protein, 216 aa, Artificial Sequence [sequence omitted]

SEQ ID NO: 11564 - protein, 250 aa, Artificial Sequence
  Description of Artificial Sequence: Synthetic coding sequence
MALRAGLVLGFHTLMTLLSPQEAGATKADHMGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWELQVPIPPPDAMETLVCALGLAIGLVGFLVGTVLIIMGTYVSSVPR

SEQ ID NO: 11565 - protein, 86 aa, Artificial Sequence
  Description of Artificial Sequence: Synthetic coding sequence
MALRAGLVLGFHTLMTLLSPQEAGATKGRAGRHRRNQSPSGHPGGALQPQQSHQRASTGDRAPQVSGGAGPAQHPHLHRGQHLPPC

SEQ ID NO: 11566 - protein, 86 aa, Artificial Sequence; identical to SEQ ID NO: 11565
  Description of Artificial Sequence: Synthetic coding sequence

SEQ ID NO: 11567 - protein, 250 aa, Artificial Sequence; identical to SEQ ID NO: 11564
  Description of Artificial Sequence: Synthetic coding sequence

SEQ ID NO: 11568 - protein, 86 aa, Artificial Sequence
  Description of Artificial Sequence: Synthetic coding sequence
MALRAGLVLGFHTLMTLLSPQEAGATKGWAGRHRRNQSPSGHPGGALQPQQSHQRASTGDRAPQVSGGAGPAQHPHLHRGQHLPPC

SEQ ID NO: 11569 - protein, 86 aa, Artificial Sequence; identical to SEQ ID NO: 11565
  Description of Artificial Sequence: Synthetic coding sequence

SEQ ID NO: 11570 - protein, 250 aa, Artificial Sequence; identical to SEQ ID NO: 11564
  Description of Artificial Sequence: Synthetic coding sequence

SEQ ID NO: 11571 - protein, 250 aa, Artificial Sequence; identical to SEQ ID NO: 11564
  Description of Artificial Sequence: Synthetic coding sequence

SEQ ID NO: 11572 - protein, 61 aa, Artificial Sequence
  Description of Artificial Sequence: Synthetic coding sequence
MALRAGLVLGFHTLMTLLSPQEAGATKADHMGSYGPPSTSLTAPRASSPMNLMRNSCSLWT

SEQ ID NO: 11573 - protein, 250 aa, Artificial Sequence; identical to SEQ ID NO: 11564
  Description of Artificial Sequence: Synthetic coding sequence

SEQ ID NO: 11574 - protein, 250 aa, Artificial Sequence; identical to SEQ ID NO: 11564
  Description of Artificial Sequence: Synthetic coding sequence

SEQ ID NO: 11575 - protein, 86 aa, Artificial Sequence; identical to SEQ ID NO: 11565
  Description of Artificial Sequence: Synthetic coding sequence

SEQ ID NO: 11576 - protein, 204 aa, Artificial Sequence
  Description of Artificial Sequence: Synthetic coding sequence
MGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWGNDPSERNDLWETPCRSSWVCDSPCVLSAL

SEQ ID NO: 11577 - protein, 250 aa, Artificial Sequence; identical to SEQ ID NO: 11564
  Description of Artificial Sequence: Synthetic coding sequence

SEQ ID NO: 11578 - protein, 86 aa, Artificial Sequence; identical to SEQ ID NO: 11568
  Description of Artificial Sequence: Synthetic coding sequence

SEQ ID NO: 11579 - protein, 86 aa, Artificial Sequence; identical to SEQ ID NO: 11565
  Description of Artificial Sequence: Synthetic coding sequence

SEQ ID NO: 11580 - protein, 61 aa, Artificial Sequence; identical to SEQ ID NO: 11572
  Description of Artificial Sequence: Synthetic coding sequence

SEQ ID NO: 11581 - protein, 61 aa, Artificial Sequence; identical to SEQ ID NO: 11572
  Description of Artificial Sequence: Synthetic coding sequence

SEQ ID NO: 11582 - protein, 204 aa, Artificial Sequence; identical to SEQ ID NO: 11576
  Description of Artificial Sequence: Synthetic coding sequence

SEQ ID NO: 11583 - protein, 204 aa, Artificial Sequence; identical to SEQ ID NO: 11576
  Description of Artificial Sequence: Synthetic coding sequence

SEQ ID NO: 11584 - protein, 204 aa, Artificial Sequence; identical to SEQ ID NO: 11576
  Description of Artificial Sequence: Synthetic coding sequence

SEQ ID NO: 11585 - protein, 61 aa, Artificial Sequence; identical to SEQ ID NO: 11572
  Description of Artificial Sequence: Synthetic coding sequence

SEQ ID NO: 11586 - protein, 204 aa, Artificial Sequence; identical to SEQ ID NO: 11576
  Description of Artificial Sequence: Synthetic coding sequence

SEQ ID NO: 11587 - protein, 204 aa, Artificial Sequence; identical to SEQ ID NO: 11576
  Description of Artificial Sequence: Synthetic coding sequence

SEQ ID NO: 11588 - protein, 61 aa, Artificial Sequence; identical to SEQ ID NO: 11572
  Description of Artificial Sequence: Synthetic coding sequence

SEQ ID NO: 11589 - protein, 61 aa, Artificial Sequence; identical to SEQ ID NO: 11572
  Description of Artificial Sequence: Synthetic coding sequence

SEQ ID NO: 11590 - protein, 61 aa, Artificial Sequence; identical to SEQ ID NO: 11572
  Description of Artificial Sequence: Synthetic coding sequence

SEQ ID NO: 11591 - protein, 204 aa, Artificial Sequence; identical to SEQ ID NO: 11576
  Description of Artificial Sequence: Synthetic coding sequence

SEQ ID NO: 11592 - protein, 182 aa, Artificial Sequence
  Description of Artificial Sequence: Synthetic coding sequence
  MOD_RES (1)..(1): Any amino acid
XNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKEVTVYPERTPLLHQHNLLHCSVTGFYPGDIKIKWFLNGQEERAGVMSTGPIRNGDWTFQTVVMLEMTPELGHVYT

SEQ ID NO: 11593 - protein, 273 aa, Artificial Sequence
  Description of Artificial Sequence: Synthetic coding sequence
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGIVIQLRAQKGYVRTQMSGNEVSRAVLLPQSC

SEQ ID NO: 11594 - protein, 273 aa, Artificial Sequence; identical to SEQ ID NO: 11593
  Description of Artificial Sequence: Synthetic coding sequence

SEQ ID NO: 11595 - protein, 182 aa, Artificial Sequence; identical to SEQ ID NO: 11592
  Description of Artificial Sequence: Synthetic coding sequence
  MOD_RES (1)..(1): Any amino acid

SEQ ID NO: 11596 - protein, 273 aa, Artificial Sequence; identical to SEQ ID NO: 11593
  Description of Artificial Sequence: Synthetic coding sequence

SEQ ID NO: 11597 - protein, 182 aa, Artificial Sequence; identical to SEQ ID NO: 11592
  Description of Artificial Sequence: Synthetic coding sequence
  MOD_RES (1)..(1): Any amino acid

SEQ ID NO: 11598 - protein, 182 aa, Artificial Sequence; identical to SEQ ID NO: 11592
  Description of Artificial Sequence: Synthetic coding sequence
  MOD_RES (1)..(1): Any amino acid

SEQ ID NO: 11599 - protein, 182 aa, Artificial Sequence; identical to SEQ ID NO: 11592
  Description of Artificial Sequence: Synthetic coding sequence
  MOD_RES (1)..(1): Any amino acid

SEQ ID NO: 11600 - protein, 273 aa, Artificial Sequence
  Description of Artificial Sequence: Synthetic coding sequence
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPISVEWRAQSEYSWRKMLSGIAAFLLGLIFLLVGIVIQLRAQKGYVRTQMSGNEVSRAVLLPQSC

SEQ ID NO: 11601 - protein, 273 aa, Artificial Sequence; identical to SEQ ID NO: 11593
  Description of Artificial Sequence: Synthetic coding sequence

SEQ ID NO: 11602 - protein, 182 aa, Artificial Sequence; identical to SEQ ID NO: 11592
  Description of Artificial Sequence: Synthetic coding sequence
  MOD_RES (1)..(1): Any amino acid

SEQ ID NO: 11603 - protein, 273 aa, Artificial Sequence; identical to SEQ ID NO: 11593
  Description of Artificial Sequence: Synthetic coding sequence

SEQ ID NO: 11604 - protein, 136 aa, Artificial Sequence
  Description of Artificial Sequence: Synthetic coding sequence
MSWKKALRIPGGLRVATVTLMLAMLSTPVAEGRDSPEDFVYQFKGMCYFTNGTERVRLVTRYIYNREEYARFDSDVGVYRAVTPLGPPDAEYWNSQKEVLERTRAELDTVCRHNYQLELRTTLQRRGTVTGPSRSW

SEQ ID NO: 11605 - protein, 279 aa, Artificial Sequence
  Description of Artificial Sequence: Synthetic coding sequence
MSWKMALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRAQSESAQSKMLGGVGGFVLGLIFLGLGLIIRHRGQKGPRGPPPAGNISAMIQSGERAQA

SEQ ID NO: 11606 - protein, 231 aa, Artificial Sequence
  Description of Artificial Sequence: Synthetic coding sequence
MSWKMALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRPRGPPPAGLLH

SEQ ID NO: 11607 - protein, 268 aa, Artificial Sequence
  Description of Artificial Sequence: Synthetic coding sequence
MSWKMALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRAQSESAQSKMLGGVGGFVLGLIFLGLGLIIRHRGQKGPRGPPPAGLLH

SEQ ID NO: 11608 - protein, 227 aa, Artificial Sequence
  Description of Artificial Sequence: Synthetic coding sequence
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRPRGPPPAGLLH

SEQ ID NO: 11609 - protein, 275 aa, Artificial Sequence
  Description of Artificial Sequence: Synthetic coding sequence
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRAQSESAQSKMLSGIGGFVLGLIFLGLGLIIRHRGQKGPRGPPPAGNISAMIQSGERAQA

SEQ ID NO: 11610 - protein, 218 aa, Artificial Sequence
  Description of Artificial Sequence: Synthetic coding sequence
  MOD_RES (1)..(1): Any amino acid
XLQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRLLH

SEQ ID NO: 11611 - protein, 231 aa, Artificial Sequence; identical to SEQ ID NO: 11606
  Description of Artificial Sequence: Synthetic coding sequence

SEQ ID NO: 11612 - protein, 218 aa, Artificial Sequence
  Description of Artificial Sequence: Synthetic coding sequence
  MOD_RES (1)..(1): Any amino acid
XLQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRLLH

SEQ ID NO: 11613 - protein, 218 aa, Artificial Sequence; identical to SEQ ID NO: 11610
  Description of Artificial Sequence: Synthetic coding sequence
  MOD_RES (1)..(1): Any amino acid

SEQ ID NO: 11614 - protein, 279 aa, Artificial Sequence; identical to SEQ ID NO: 11605
  Description of Artificial Sequence: Synthetic coding sequence

SEQ ID NO: 11615 - protein, 264 aa, Artificial Sequence
  Description of Artificial Sequence: Synthetic coding sequence
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRAQSESAQSKMLSGIGGFVLGLIFLGLGLIIRHRGQKGPRGPPPAGLLH

SEQ ID NO: 11616 - protein, 218 aa, Artificial Sequence; identical to SEQ ID NO: 11612
  Description of Artificial Sequence: Synthetic coding sequence
  MOD_RES (1)..(1): Any amino acid

SEQ ID NO: 11617 - protein, 218 aa, Artificial Sequence; identical to SEQ ID NO: 11610
  Description of Artificial Sequence: Synthetic coding sequence
  MOD_RES (1)..(1): Any amino acid

SEQ ID NO: 11618 - protein, 227 aa, Artificial Sequence; identical to SEQ ID NO: 11608
  Description of Artificial Sequence: Synthetic coding sequence

SEQ ID NO: 11619 - protein, 218 aa, Artificial Sequence; identical to SEQ ID NO: 11612
  Description of Artificial Sequence: Synthetic coding sequence
  MOD_RES (1)..(1): Any amino acid

SEQ ID NO: 11620 - protein, 231 aa, Artificial Sequence; identical to SEQ ID NO: 11606
  Description of Artificial Sequence: Synthetic coding sequence

SEQ ID NO: 11621 - protein, 264 aa, Artificial Sequence; identical to SEQ ID NO: 11615
  Description of Artificial Sequence: Synthetic coding sequence

SEQ ID NO: 11622 - protein, 264 aa, Artificial Sequence; identical to SEQ ID NO: 11615
  Description of Artificial Sequence: Synthetic coding sequence

SEQ ID NO: 11623 - protein, 268 aa, Artificial Sequence; identical to SEQ ID NO: 11607
  Description of Artificial Sequence: Synthetic coding sequence

SEQ ID NO: 11624 - protein, 268 aa, Artificial Sequence; identical to SEQ ID NO: 11607
  Description of Artificial Sequence: Synthetic coding sequence

SEQ ID NO: 11625 - protein, 231 aa, Artificial Sequence; identical to SEQ ID NO: 11606
  Description of Artificial Sequence: Synthetic coding sequence

SEQ ID NO: 11626 - protein, 279 aa, Artificial Sequence; identical to SEQ ID NO: 11605
  Description of Artificial Sequence: Synthetic coding sequence

SEQ ID NO: 11627 - protein, 218 aa, Artificial Sequence; identical to SEQ ID NO: 11612
  Description of Artificial Sequence: Synthetic coding sequence
  MOD_RES (1)..(1): Any amino acid

SEQ ID NO: 11628 - protein, 275 aa, Artificial Sequence; identical to SEQ ID NO: 11609
  Description of Artificial Sequence: Synthetic coding sequence

SEQ ID NO: 11629 - protein, 264 aa, Artificial Sequence; identical to SEQ ID NO: 11615
  Description of Artificial Sequence: Synthetic coding sequence

SEQ ID NO: 11630 - protein, 227 aa, Artificial Sequence; identical to SEQ ID NO: 11608
  Description of Artificial Sequence: Synthetic coding sequence

SEQ ID NO: 11631 - protein, 279 aa, Artificial Sequence; identical to SEQ ID NO: 11605
  Description of Artificial Sequence: Synthetic coding sequence

SEQ ID NO: 11632 - protein, 275 aa, Artificial Sequence; identical to SEQ ID NO: 11609
  Description of Artificial Sequence: Synthetic coding sequence

SEQ ID NO: 11633 - protein, 218 aa, Artificial Sequence; identical to SEQ ID NO: 11610
  Description of Artificial Sequence: Synthetic coding sequence
  MOD_RES (1)..(1): Any amino acid

SEQ ID NO: 11634 - protein, 275 aa, Artificial Sequence; identical to SEQ ID NO: 11609
  Description of Artificial Sequence: Synthetic coding sequence

SEQ ID NO: 11635 - protein, 227 aa, Artificial Sequence; identical to SEQ ID NO: 11608
  Description of Artificial Sequence: Synthetic coding sequence

SEQ ID NO: 11636 - protein, 268 aa, Artificial Sequence; identical to SEQ ID NO: 11607
  Description of Artificial Sequence: Synthetic coding sequence

SEQ ID NO: 11637 - protein, 208 aa, Artificial Sequence
  Description of Artificial Sequence: Synthetic coding sequence
MLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRPRGPPPAGLLH

SEQ ID NO: 11638 - protein, 275 aa, Artificial Sequence
  Description of Artificial Sequence: Synthetic coding sequence
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVQWFRNDQEETAGVVSTSLIRNGDWTFQILVMLEITPQRGDIYTCQVEHPSLQSPITVEWRAQSESAQSKMLGGVGGFVLGLIFLGLGLIIRHRGQKGPRGPPPAGNISAMIQSGERAQA

SEQ ID NO: 11639 - protein, 208 aa, Artificial Sequence
  Description of Artificial Sequence: Synthetic coding sequence
MLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRPRGPPPAGLLH

SEQ ID NO: 11640 - protein, 208 aa, Artificial Sequence; identical to SEQ ID NO: 11637
  Description of Artificial Sequence: Synthetic coding sequence

SEQ ID NO: 11641 - protein, 208 aa, Artificial Sequence; identical to SEQ ID NO: 11637
  Description of Artificial Sequence: Synthetic coding sequence

SEQ ID NO: 11642 - protein, 208 aa, Artificial Sequence; identical to SEQ ID NO: 11639
  Description of Artificial Sequence: Synthetic coding sequence

SEQ ID NO: 11643 - protein, 208 aa, Artificial Sequence; identical to SEQ ID NO: 11637
  Description of Artificial Sequence: Synthetic coding sequence

SEQ ID NO: 11644 - protein, 275 aa, Artificial Sequence; identical to SEQ ID NO: 11638
  Description of Artificial Sequence: Synthetic coding sequence

SEQ ID NO: 11645 - protein, 208 aa, Artificial Sequence; identical to SEQ ID NO: 11639
  Description of Artificial Sequence: Synthetic coding sequence

SEQ ID NO: 11646 - protein, 275 aa, Artificial Sequence; identical to SEQ ID NO: 11638
  Description of Artificial Sequence: Synthetic coding sequence

SEQ ID NO: 11647 - protein, 275 aa, Artificial Sequence; identical to SEQ ID NO: 11638
  Description of Artificial Sequence: Synthetic coding sequence

SEQ ID NO: 11648 - protein, 229 aa, Artificial Sequence
  Description of Artificial Sequence: Synthetic coding sequence
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGLRKSNAAERRGPL

SEQ ID NO: 11649 - protein, 254 aa, Artificial Sequence
  Description of Artificial Sequence: Synthetic coding sequence
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGLRKSNAAERRGPL

SEQ ID NO: 11650 - protein, 229 aa, Artificial Sequence
  Description of Artificial Sequence: Synthetic coding sequence
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGVRKSNAAERRGPL

SEQ ID NO: 11651 - protein, 254 aa, Artificial Sequence
  Description of Artificial Sequence: Synthetic coding sequence
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGVRKSNAAERRGPL

SEQ ID NO: 11652 - protein, 254 aa, Artificial Sequence; identical to SEQ ID NO: 11649
  Description of Artificial Sequence: Synthetic coding sequence

SEQ ID NO: 11653 - protein, 229 aa, Artificial Sequence; identical to SEQ ID NO: 11650
  Description of Artificial Sequence: Synthetic coding sequence

SEQ ID NO: 11654 - protein, 254 aa, Artificial Sequence; identical to SEQ ID NO: 11651
  Description of Artificial Sequence: Synthetic coding sequence

SEQ ID NO: 11655 - protein, 254 aa, Artificial Sequence; identical to SEQ ID NO: 11651
  Description of Artificial Sequence: Synthetic coding sequence

SEQ ID NO: 11656 - protein, 229 aa, Artificial Sequence; identical to SEQ ID NO: 11650
  Description of Artificial Sequence: Synthetic coding sequence

SEQ ID NO: 11657 - protein, 254 aa, Artificial Sequence; identical to SEQ ID NO: 11651
  Description of Artificial Sequence: Synthetic coding sequence

SEQ ID NO: 11658 - protein, 229 aa, Artificial Sequence; identical to SEQ ID NO: 11650
  Description of Artificial Sequence: Synthetic coding sequence

SEQ ID NO: 11659 - protein, 229 aa, Artificial Sequence; identical to SEQ ID NO: 11650
  Description of Artificial Sequence: Synthetic coding sequence

SEQ ID NO: 11660 - protein, 229 aa, Artificial Sequence; identical to SEQ ID NO: 11648
  Description of Artificial Sequence: Synthetic coding sequence

SEQ ID NO: 11661 - protein, 254 aa, Artificial Sequence; identical to SEQ ID NO: 11651
  Description of Artificial Sequence: Synthetic coding sequence

SEQ ID NO: 11662 - protein, 180 aa, Artificial Sequence
  Description of Artificial Sequence: Synthetic coding sequence
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSKPSPRDYRERGVCPGPDCGSGGHHYWDHLHHQGIAQKQCSRTQGASVRHMEVMVFLREKITEETSALMALQSWQYYNP

SEQ ID NO: 11663 - protein, 237 aa, Artificial Sequence [sequence omitted]

SEQ ID NO: 11664 - protein, 165 aa, Artificial Sequence
  Description of Artificial Sequence: Synthetic coding sequence
MAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLSIAFSCIYFPLFPIILLSPCNASGIKHTGVCLCYGMPHGASLVYLLFKVSSNCDFSEHNKLF

SEQ ID NO: 11665 - protein, 150 aa, Artificial Sequence
  Description of Artificial Sequence: Synthetic coding sequence
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIIKGVRKSNAAERRGPL

SEQ ID NO: 11666 - protein, 180 aa, Artificial Sequence [sequence omitted]

SEQ ID NO: 11667 - protein, 180 aa, Artificial Sequence [sequence omitted]

SEQ ID NO: 11668 - protein, 165 aa, Artificial Sequence; identical to SEQ ID NO: 11664
  Description of Artificial Sequence: Synthetic coding sequence

SEQ ID NO: 11669 - protein, 180 aa, Artificial Sequence [sequence omitted]

SEQ ID NO: 11670 - protein, 165 aa, Artificial Sequence; identical to SEQ ID NO: 11664
  Description of Artificial Sequence: Synthetic coding sequence

SEQ ID NO: 11671 - protein, 237 aa, Artificial Sequence [sequence omitted]

SEQ ID NO: 11672 - protein, 180 aa, Artificial Sequence [sequence omitted]

SEQ ID NO: 11673 - protein, 165 aa, Artificial Sequence; identical to SEQ ID NO: 11664
  Description of Artificial Sequence: Synthetic coding sequence

SEQ ID NO: 11674 - protein, 165 aa, Artificial Sequence; identical to SEQ ID NO: 11664
  Description of Artificial Sequence: Synthetic coding sequence

SEQ ID NO: 11675 - protein, 237 aa, Artificial Sequence [sequence omitted]

SEQ ID NO: 11676 - protein, 180 aa, Artificial Sequence
  Description of Artificial Sequence: Synthetic coding sequence
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSKPSPRDYRECGVCPGPDCGSGGHHYWDHLHHQGSAQKQCSRTQGASVRHMEVMMFLREKITEETSALMTLQSWQYYNP

SEQ ID NO: 11677 - protein, 165 aa, Artificial Sequence; identical to SEQ ID NO: 11664
  Description of Artificial Sequence: Synthetic coding sequence

SEQ ID NO: 11678 - protein, 237 aa, Artificial Sequence [sequence omitted]

SEQ ID NO: 11679 - protein, 266 aa, Artificial Sequence
  Description of Artificial Sequence: Synthetic coding sequence
MVCLKLPGGSCMAALTVTLTVLSSPLALAGDTQPRFLEQAKCECHFLNGTERVWNLIRYIYNQEEYARYNSDLGEYQAVTELGRPDAEYWNSQKDLLERRRAEVDTYCRYNYGVVESFTVQRRVQPKVTVYPSKTQPLQHHNLLVCSVNGFYPGSIEVRWFRNGQEEKAGVVSTGLIQNGDWTFQTLVMLETVPRSGEVYTCQVEHPSMMSPLTVQWSARSESAQSKMLSGVGGFVLGLLFLGTGLFIYFRNQKGHSGLQPTGLLS

SEQ ID NO: 11680 - protein, 266 aa, Artificial Sequence
  Description of Artificial Sequence: Synthetic coding sequence
MVCLKLPGGSCMAALTVTLTVLSSPLALAGDTQPRFLEQAKCECHFLNGTERVWNLIRYIYNQEEYARYNSDLGEYQAVTELGRPDAEYWNSQKDLLERRRAEVDTYCRYNYGVVESFTVQRRVQPKVTVYPSKTQPLQHHNLLVCSVNGFYPGSIEVRWFRNSQEEKAGVVSTGLIQNGDWTFQTLVMLETVPRSGEVYTCQVEHPSMMSPLTVQWSARSESAQSKMLSGVGGFVLGLLFLGTGLFIYFRNQKGHSGLQPTGLLS

SEQ ID NO: 11681 - protein, 266 aa, Artificial Sequence; identical to SEQ ID NO: 11679
  Description of Artificial Sequence: Synthetic coding sequence

SEQ ID NO: 11682 - protein, 390 aa, Artificial Sequence
  Description of Artificial Sequence: Synthetic coding sequence
MSVRVARVAWVRGLGASYRRGASSFPVPPPGAQGVAELLRDATGAEEEAPWAATERRMPGQCSVLLFPGQGSQVVGMGRGLLNYPRVRELYAAARRVLGYDLLELSLHGPQETLDRTVHCQPAIFVASLAAVEKLHHLQPSVIENCVAAAGFSVGEFAALVFAGAMEFAEGLYAVKIRAEAMQEASEAVPSGMLSVLGQPQSKFNFACLEAREHCKSLGIENPVCEVSNYLFPDCRVISGHQEALRFLQKNSSKFHFRRTRMLPVSGAFHTRLMEPAVEPLTQALKAVDIKKPLVSVYSNVHAHRYRHPGHIHKLLAQQLVSPVKWEQTMHAIYERKKGRGFPQTFEVGPGRQLGAILKSCNMQAWKSYSAVDVLQTLEHVDLDPQEPPR

SEQ ID NO: 11683 - protein, 180 aa, Artificial Sequence
  Description of Artificial Sequence: Synthetic coding sequence
MSVRVARVAWVRGLGASYRRGASSFPVPPPGAQGVAELLRDATGAEEEAPWAATERRMPGQCSVLLFPGQGSQVVGMGRGLLNYPRVRELYAAARRVLGYDLLELSLHGPQETLDRTVHCQPAIFVASLAAVEKLHHLQPSVIENCVAAAGFSVGEFAALVFAGAMEFAEGSTVSPEEFL

SEQ ID NO: 11684 - protein, 1137 aa, Artificial Sequence
  Description of Artificial Sequence: Synthetic coding sequence
MPLSSHLLPALVLFLAGSSGWAWVPNHCRSPGQAVCNFVCDCRDCSDEAQCGYHGASPTLGAPFACDFEQDPCGWRDISTSGYSWLRDRAGAALEGPGPHSDHTLGTDLGWYMAVGTHRGKEASTAALRSPTLREAASSCKLRLWYHAASGDVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRAGGPERPSWPRRDHSRNSAQGSFLVSVAEPGTPAILSSPEFQASGTSNCSLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPREVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVVFEAVAAGVAHSYVALDDLLLQDGPCPQPGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 11685 - protein, 1202 aa, Artificial Sequence
  Description of Artificial Sequence: Synthetic coding sequence
  MOD_RES (1)..(1): Any amino acid
XGWAWVPNHCRSPGQAVCNFVCDCRDCSDEAQCGYHGASPTLGAPFACDFEQDPCGWRDISTSGYSWLRDRAGAALEGPGPHSDHTLGTDLGWYMAVGTHRGKEASTAALRSPTLREAASSCKLRLWYHAASGDVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRAGGPERPSWPRRDHSRNSAQGSFLVSVAEPGTPAILSSPEFQASGTSNCSLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGEAQGHFLSLQRAWGQLGAEARVLTPLLGPSGPSCELHLAYYLQSQPRGFLALVVVDNGSRELAWQALSSSAGIWKVDKVLLGARRRPFRLEFVGLVDLDGPDQQGAGVDNVTLRDCSPTVTTERDREVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVVFEAVAAGVAHSYVALDDLLLQDGPCPQPGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 11686 - protein, 1216 aa, Artificial Sequence
  Description of Artificial Sequence: Synthetic coding sequence
MPLSSHLLPALVLFLAGSSGWAWVPNHCRSPGQAVCNFVCDCRDCSDEAQCGYHGASPTLGAPFACDFEQDPCGWRDISTSGYSWLRDRAGAALEGPGPHSDHTLGTDLGWYMAVGTHRGKEASTAALRSPTLREAASSCKLRLWYHAASGDVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRAGGPERPSWPRRDHSRNSAQGSFLVSVAEPGTPAILSSPEFQASGTSNCSLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRGFLALVVVDNGSRELAWQALSSSAGIWKVDKVLLGARRRPFRLEFVGLVDLDGPDQQGAGVDNVTLRDCSPTVTTERDREVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVVFEAVAAGVAHSYVALDDLLLQDGPCPQPGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 11687 - protein, 450 aa, Artificial Sequence
  Description of Artificial Sequence: Synthetic coding sequence
MMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 11688 - protein, 401 aa, Artificial Sequence
  Description of Artificial Sequence: Synthetic coding sequence
MELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 11689 - protein, 389 aa, Artificial Sequence
  Description of Artificial Sequence: Synthetic coding sequence
MMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEGAGLGEILSDRSRFLWDPRRVQ

SEQ ID NO: 11690 - protein, 630 aa, Artificial Sequence
  Description of Artificial Sequence: Synthetic coding sequence
MLMRKVPGFVPASPWGLRLPQKFLFLLFLSGLVTLCFGALFLLPHSSRLKRLFLAPRTQQPGLEVVAEIAGHAPAREQEPPPNPAPAAPAPGEDDPSSWASPRRRKGGLRRTRPTGPREEATAARGNSIPASRPGDEGVPFRFDFNAFRSRLRHPVLGTRADESQEPQSQVRAQREKIKEMMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 11691 - protein, 85 aa, Artificial Sequence
  Description of Artificial Sequence: Synthetic coding sequence
MASDLDFSPPEVPEPTFLENLLRYGLFLGAIFQLICVLAIIVPIPKSHEAEAEPSEPRSAEVTRKPKAAVPSVNKRPKKETKKKR

SEQ ID NO: 11692 - protein, 85 aa, Artificial Sequence; identical to SEQ ID NO: 11691
  Description of Artificial Sequence: Synthetic coding sequence

SEQ ID NO: 11693 - protein, 56 aa, Artificial Sequence
  Description of Artificial Sequence: Synthetic coding sequence
MASDLDFSPPEVPEPTFLENLLRYGLFLGAIFQLICVLAIIVPIPKSHEAEFHVEA

SEQ ID NO: 11694 - protein, 85 aa, Artificial Sequence; identical to SEQ ID NO: 11691
  Description of Artificial Sequence: Synthetic coding sequence

SEQ ID NO: 11695 - protein, 85 aa, Artificial Sequence; identical to SEQ ID NO: 11691
  Description of Artificial Sequence: Synthetic coding sequence

SEQ ID NO: 11696 - protein, 85 aa, Artificial Sequence; identical to SEQ ID NO: 11691
  Description of Artificial Sequence: Synthetic coding sequence

SEQ ID NO: 11697 - protein, 235 aa, Artificial Sequence
  Description of Artificial Sequence: Synthetic coding sequence
MITGSPQMTWCPPFWTPPISTASRYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 11698 - protein, 457 aa, Artificial Sequence
  Description of Artificial Sequence: Synthetic coding sequence
MARRRRRACIALFLVLLFAFGTLMGLRTLKAPDGLPALGPGLELAPFERRPEGAPAPAARAPAAPAAPPPPPPPPRTADPGGSPGPAPAEAEPAPVQSLRVYSDLHAFYYSWYGSPRREGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVAFHIQPYKGRDDITVHDNIKYIIDTYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 11699 - protein, 250 aa, Artificial Sequence
  Description of Artificial Sequence: Synthetic coding sequence
MARRRRRACIALFLVLLFAFGTLMGLRTLKAPDGLPALGPGLELAPFERRPEGAPAPAARAPAAPAAPPPPPPPPRTADPGGSPGPAPAEAEPAPVQSLRVYSDLHAFYYSWYGSPRREGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVAFHIQPYKGRDDITVHDNIKYIIDTTGKL

SEQ ID NO: 11700 - protein, 478 aa, Artificial Sequence
  Description of Artificial Sequence: Synthetic coding sequence
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIAGRLMVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTGTEDRQNDILHHGALDVGENVMPSKQRRQCSTYLRLGEFKNGNFEMSGVNQKIPFDIHCMRIYVTKTQKEWLIIRSISIWTS

SEQ ID NO: 11701 - protein, 507 aa, Artificial Sequence
  Description of Artificial Sequence: Synthetic coding sequence
MLGKDMVRFVVRKTVQRSVAKGSRRCKKRMFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIAGRLMVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTGTEDRQNDILHHGALDVGENVMPSKQRRQCSTYLRLGEFKNGNFEMSGVNQKIPFDIHCMRIYVTKTQKEWLIIRSISIWTS

SEQ ID NO: 11702 - protein, 398 aa, Artificial Sequence
  Description of Artificial Sequence: Synthetic coding sequence
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIAGRLMVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTGT

SEQ ID NO: 11703 - protein, 478 aa, Artificial Sequence; identical to SEQ ID NO: 11700
  Description of Artificial Sequence: Synthetic coding sequence

SEQ ID NO: 11704 - protein, 478 aa, Artificial Sequence; identical to SEQ ID NO: 11700
  Description of Artificial Sequence: Synthetic coding sequence

SEQ ID NO: 11705 - protein, 478 aa, Artificial Sequence; identical to SEQ ID NO: 11700
  Description of Artificial Sequence: Synthetic coding sequence

SEQ ID NO: 11706 - protein, 478 aa, Artificial Sequence; identical to SEQ ID NO: 11700
  Description of Artificial Sequence: Synthetic coding sequence

SEQ ID NO: 11707 - protein, 837 aa, Artificial Sequence
  Description of Artificial Sequence: Synthetic coding sequence
MARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 11708 - protein, 731 aa, Artificial Sequence
  Description of Artificial Sequence: Synthetic coding sequence
MKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 11709 - protein, 159 aa, Artificial Sequence
  Description of Artificial Sequence: Synthetic coding sequence
MARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLRYFCPPFGLPVLLCGDRWQGSPTTRGWGQGAVEVYQWAHQ

SEQ ID NO: 11710 - protein, 431 aa, Artificial Sequence
  Description of Artificial Sequence: Synthetic coding sequence
MFFGGEGSLTYTLVIICFLTLRLSASQNCLKKSLEDVVIDIQSSLSKGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 11711 - protein, 57 aa, Artificial Sequence
  Description of Artificial Sequence: Synthetic coding sequence
MFFGGEGSLTYTLVIICFLTLRLSASQNCLKKSLEDVVIDIQSSLSKGIRGNEPVYT

SEQ ID NO: 11712 - protein, 204 aa, Artificial Sequence
  Description of Artificial Sequence: Synthetic coding sequence
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRVQKEQLAAIFKLMKDNKETFGEMSDGDVQEQLRLYDM

SEQ ID NO: 11713 - protein, 177 aa, Artificial Sequence
  Description of Artificial Sequence: Synthetic coding sequence
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRIELTSDLTSL

SEQ ID NO: 11714 - protein, 170 aa, Artificial Sequence
  Description of Artificial Sequence: Synthetic coding sequence
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRTQR

SEQ ID NO: 11715 - protein, 170 aa, Artificial Sequence
  Description of Artificial Sequence: Synthetic coding sequence
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRTEE

SEQ ID NO: 11716 - protein, 442 aa, Artificial Sequence
  Description of Artificial Sequence: Synthetic coding sequence
MALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 11717 - protein, 341 aa, Artificial Sequence
  Description of Artificial Sequence: Synthetic coding sequence
MALPSRILLWKLVLLQSSAVLLHSAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 11718 - protein, 433 aa, Artificial Sequence
  Description of Artificial Sequence: Synthetic coding sequence
MIRCAATGSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 11719 - protein, 450 aa, Artificial Sequence
  Description of Artificial Sequence: Synthetic coding sequence
MALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLASSPPTDYKNNILKERAELAHSPLPAKYIDLDKDPSGLCPLGA

SEQ ID NO: 11720 - protein, 68 aa, Artificial Sequence
  Description of Artificial Sequence: Synthetic coding sequence
MPQKDPCQKQACEIQKCLQANSYMESKCQAVIQELRKCCAQYPKGRSVVCSGFEKEEEENLTRKSASK

SEQ ID NO: 11721 - protein, 68 aa, Artificial Sequence; identical to SEQ ID NO: 11720
  Description of Artificial Sequence: Synthetic coding sequence

SEQ ID NO: 11722 - protein, 205 aa, Artificial Sequence
  Description of Artificial Sequence: Synthetic coding sequence
MSAQRLISNRTSQQSASNSDYTWEYEYYEIGPVSFEGLKAHKYSIVIGFWVGLAVFVIFMFFVLTLLTKTGAPHQDNAESSEKRFRMNSFVSDFGRPLEPDKVFSRQGNEESRSLFHCYINEVERLDRAKACHQTTALDSDVQLQEAIRSSGQPEEELNRLMKFDIPNFVNTDQNYFGEDDLLISEPPIVLETKPLSQTSHKDLD

SEQ ID NO: 11723 - protein, 309 aa, Artificial Sequence
  Description of Artificial Sequence: Synthetic coding sequence
MSLEQRSLHCKPEEALEAQQEALGLVCVQAATSSSSPLVLGTLEEVPTAGSTDPPQSPQGASAFPTTINFTRQRQPSEGSSSREEEGPSTSCILESLFRAVITKKVADLVGFLLLKYRAREPVTKAEMLESVIKNYKHCFPEIFGKASESLQLVFGIDVKEADPTGHSYVLVTCLGLSYDGLLGDNQIMPKTGFLIIVLVMIAMEGGHAPEEEIWEELSVMEVYDGREHSAYGEPRKLLTQDLVQEKYLEYRQVPDSDPARYEFLWGPRALAETSYVKVLEYVIKVSARVRFFFPSLREAALREEEEGV

SEQ ID NO: 11724 - protein, 1455 aa, Artificial Sequence
  Description of Artificial Sequence: Synthetic coding sequence
MSKSLKKKSHWTSKVHESVIGRNPEGQLGFELKGGAENGQFPYLGEVKPGKVAYESGSKLVSEELLLEVNETPVAGLTIRDVLAVIKHCKDPLRLKCVKQGGIVDKDLRHYLNLRFQKGSVDHELQQIIRDNLYLRTVPCTTRPHKEGEVPGVDYIFITVEDFMELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRQQVPPRTSFRMDSSGPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYDEPAPWSSPAAAAPGLPEVGVSLDDGLAPFSPSHPAPPSDPSHQISPGPTWDIKREHDVRKPKELSACGQKKQRLGEQRERSASPQRAARPRLEEAPGGQGRPEAGRPASEARAPGLAAADAADAARAGGKEAPRAAAGSELCRREGPGAAPAFAGPGGGGSGALEAEGRAGARAGPRPGPRPPGGAPARKAAVAPGPWKVPGSDKLPSVLKPGASAASR

SEQ ID NO: 11725 - protein, 1441 aa, Artificial Sequence
  Description of Artificial Sequence: Synthetic coding sequence
MSKSLKKKSHWTSKVHESVIGRNPEGQLGFELKGGAENGQFPYLGEVKPGKVAYESGSKLVSEELLLEVNETPVAGLTIRDVLAVIKHCKDPLRLKCVKQGGIVDKDLRHYLNLRFQKGSVDHELQQIIRDNLYLRTVPCTTRPHKEGEVPGVDYIFITVEDFMELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRRPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYDEPAPWSSPAAAAPGLPEVGVSLDDGLAPFSPSHPAPPSDPSHQISPGPTWDIKREHDVRKPKELSACGQKKQRLGEQRERSASPQRAARPRLEEAPGGQGRPEAGRPASEARAPGLAAADAADAARAGGKEAPRAAAGSELCRREGPGAAPAFAGPGGGGSGALEAEGRAGARAGPRPGPRPPGGAPARKAAVAPGPWKVPGSDKLPSVLKPGASAASR

SEQ ID NO: 11726 - protein, 555 aa, Artificial Sequence
  Description of Artificial Sequence: Synthetic coding sequence
MELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGKTNTGSAIKYVGKIVGSFNNIVKMQISLELNEIIL

SEQ ID NO: 11727 - protein, 1253 aa, Artificial Sequence
  Description of Artificial Sequence: Synthetic coding sequence
MSKSLKKKSHWTSKVHESVIGRNPEGQLGFELKGGAENGQFPYLGEVKPGKVAYESGSKLVSEELLLEVNETPVAGLTIRDVLAVIKHCKDPLRLKCVKQGGIVDKDLRHYLNLRFQKGSVDHELQQIIRDNLYLRTVPCTTRPHKEGEVPGVDYIFITVEDFMELEKSGALLESGTYEDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGFFSPWKTPKPIMDRWENQGSPQTSLSAPAIPQNLPFPPALHRSSFPDSTEAFDPRKPDPYELYEKSRAIYESRQQVPPRTSFRMDSSGPDYKELDVHLRRMESGFGFRILGGDEPGQPILIGAVIAMGSADRDGRLHPGDELVYVDGIPVAGKTHRYVIDLMHHAARNGQVNLTVRRKVLCGGEPCPENGRSPGSVSTHHSSPRSDYATYTNSNHAAPSSNASPPEGFASHSLQTSDVVIHRKENEGFGFVIISSLNRPESGSTITVPHKIGRIIDGSPADRCAKLKVGDRILAVNGQSIINMPHADIVKLIKDAGLSVTLRIIPQEELNSPTSAPSSEKQSPMAQQSPLAQQSPLAQPSPATPNSPIAQPAPPQPLQLQGHENSYRSEVKARQDVKPDIRQPPFTDYRQPPLDYRQPPGGDYQQPPPLDYRQPPLLDYRQHSPDTRQYPLSDYRQPQDFDYFTVDMEKGAKGFGFSIRGGREYKMDLYVLRLAEDGPAIRNGRMRVGDQIIEINGESTRDMTHARAIELIKSGGRRVRLLLKRGTGQVPEYDPPAPAQAVLLRFRLTAF

SEQ ID NO: 11728 - protein, 550 aa, Artificial Sequence
  Description of Artificial Sequence: Synthetic coding sequence
MISAHRNLCLPDNYYGTPKPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKENELPYGWEKIDDPIYGTYYVDHINRRTQFENPVLEAKRKLQQHNMPHTELGTKPLQAPGFREKPLFTRDASQLKGTFLSTTLKKSNMGFGFTIIGGDEPDEFLQVKSVIPDGPAAQDGKMETGDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGGKTNTGSAIKYVGKIVGSFNNIVKMQISLELNEIIL

SEQ ID NO: 11729 - protein, 472 aa, Artificial Sequence
  Description of Artificial Sequence: Synthetic coding sequence
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 11730 - protein, 399 aa, Artificial Sequence
  Description of Artificial Sequence: Synthetic coding sequence
MGSSRCGPGAHPVHLWPPHFAFSGHHPRDLGPHSGPALLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 11731 - protein, 344 aa, Artificial Sequence
  Description of Artificial Sequence: Synthetic coding sequence
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLR

SEQ ID NO: 11732 - protein, 256 aa, Artificial Sequence
  Description of Artificial Sequence: Synthetic coding sequence
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGC

SEQ ID NO: 11733 - protein, 399 aa, Artificial Sequence; identical to SEQ ID NO: 11730
  Description of Artificial Sequence: Synthetic coding sequence

SEQ ID NO: 11734 - protein, 170 aa, Artificial Sequence
  Description of Artificial Sequence: Synthetic coding sequence
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRY

SEQ ID NO: 11735 - protein, 579 aa, Artificial Sequence
  Description of Artificial Sequence: Synthetic coding sequence
MKDFSDVILCMEATESSKTEFCNPAFEPESGPPCPPPVFPEDASYSVPAPWHGRRPRGLRPDCRFSWLCVLLLSSLLLLLLGLLVAIILAQLQAAPPSGASHSPLPAGGLTTTTTTPTITTSQAAGTPKGQQESGVSPSPQSTCGGLLSGPRGFFSSPNYPDPYPPNTHCVWHIQVATDHAIQLKIEALSIESVASCLFDRLELSPEPEGPLLRVCGRVPPPTLNTNASHLLVVFVSDSSVEGFGFHAWYQAMAPGRGSCAHDEFRCDQLICLLPDSVCDGFANCADGSDETNCSAKFSGCGGNLTGLQGTFSTPSYLQQYPHQLLCTWHISVPAGHSIELQFHNFSLEAQDECKFDYVEVYETSSSGAFSLLGRFCGAEPPPHLVSSHHELAVLFRTDHGISSGGFSATYLAFNATENPCGPSELSCQAGGCKGVQWMCDMWRDCTDGSDDNCSGPLFPPPELACEPVQVEMCLGLSYNTTAFPNIWVGMITQEEVVEVLSGYKSLTSLPCYQHFRRLLCGLLVPRCTPLGSVLPPCRSVCQEAEHQCQSGLALLGTPWPFNCNRLPEAADLEACAQP

SEQ ID NO: 11736 - protein, 579 aa, Artificial Sequence; identical to SEQ ID NO: 11735
  Description of Artificial Sequence: Synthetic coding sequence

SEQ ID NO: 11737 - protein, 131 aa, Artificial Sequence
  Description of Artificial Sequence: Synthetic coding sequence
MAPSLWKGLVGIGLFALAHAAFSAAQHRSYMRLTEKEDESLPIDIVLQTLLAFAVTCYGIVHIAGEFKDMDATSELKNKTFDTLRNHPSFYVFNHRGRVLFRPSDTANSSNQDALSSNTSLKLRKLESLRR

SEQ ID NO: 11738 - protein, 196 aa, Artificial Sequence
  Description of Artificial Sequence: Synthetic coding sequence
MTPLGSGPPREASIAQPSGFSTTETLCAQDFSDVIFLRRADTRRWKKKQLRRPSLLLLGCCSFGIMAPSLWKGLVGIGLFALAHAAFSAAQHRSYMRLTEKEDESLPIDIVLQTLLAFAVTCYGIVHIAGEFKDMDATSELKNKTFDTLRNHPSFYVFNHRGRVLFRPSDTANSSNQDALSSNTSLKLRKLESLRR

SEQ ID NO: 11739 - protein, 712 aa, Artificial Sequence
  Description of Artificial Sequence: Synthetic coding sequence
MESTSQDRRATHVITIKPNETVLTAFPYRPHSSLLDFLKGEPRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIGILLILLIISIAELSISVTIASFRSKCWTQSDEVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 11740 - protein, 112 aa, Artificial Sequence
  Description of Artificial Sequence: Synthetic coding sequence
MIGIFHIFMWYFLLVLYMGQIKGAFGTYEPVTYKTGCTLWGIFFIIAGVFLIRVTKYPTRSGKLGREVSRILLFFYGLEFSIALTHSIYSCSNLFRRQNDLTSVTEEAESTP

SEQ ID NO: 11741 - protein, 152 aa, Artificial Sequence
  Description of Artificial Sequence: Synthetic coding sequence
MIGIFHIFMWYFLLVLYMGQIKGAFGTYEPVTYKTGCTLWGIFFIIAGVFLIRVTKYPTRSGIISTLIINIICIITTITAVTLTIIELSHFNSVSYRNYGQAKLGREVSRILLFFYGLEFSIALTHSIYSCSNLFRRQNDLTSVTEEAESTP

SEQ ID NO: 11742 - protein, 93 aa, Artificial Sequence
  Description of Artificial Sequence: Synthetic coding sequence
MIGIFHIFMWYFLLVLYMGQIKGAFGTYEPVTYKTGCTLWGIFKLGREVSRILLFFYGLEFSIALTHSIYSCSNLFRRQNDLTSVTEEAESTP

SEQ ID NO: 11743 - protein, 679 aa, Artificial Sequence
  Description of Artificial Sequence: Synthetic coding sequence
MESTSQDRRATHVITIKPNETVLTAFPYRPHSSLLDFLKGEPRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 11744 - protein, 58 aa, Artificial Sequence
  Description of Artificial Sequence: Synthetic coding sequence
MNVISSLVAITGITFTILSYRHQDKYCQMPSFEEICVFSRTLFIDFILLTPPHSSHFL

SEQ ID NO: 11745 - protein, 662 aa, Artificial Sequence
  Description of Artificial Sequence: Synthetic coding sequence
MESTSQDRRATHVITIKPNETVLTAFPYRPHSSLLDFLKGEPRVLGATQILLALIIVGFGTIFALNYIGFSQRLPLVVLTGYPFWGALIGQGVTGMNVISSLVAITGITFTILSYRHQDKYCQMPSFEEICVFSRTLFIVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 11746 - protein, 567 aa, Artificial Sequence
  Description of Artificial Sequence: Synthetic coding sequence
MNVISSLVAITGITFTILSYRHQDKYCQMPSFEEICVFSRTLFIVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 11747 - protein, 147 aa, Artificial Sequence
  Description of Artificial Sequence: Synthetic coding sequence
MVRRGHVGIFFIEGGVPFWGGACFIISGSLSVAAEKNHTSCLVRSSLGTNILSVMAAFAGTAILLMDFGVTNRDVDRGYLAVLTIFTVLEFFTAVIAMHFGCQAIHAQASAPVIFLPNAFSADFNIPSPAASAPPAYDNVAYAQGVV

SEQ ID NO: 11748 - protein, 240 aa, Artificial Sequence
  Description of Artificial Sequence: Synthetic coding sequence
MSAAPASNGVFVVIPPNNASGLCPPPAILPTSMCQPPGIMQFEEPPLGAQTPRATQPPDLRPVETFLTGEPKVLGTVQILIGLIHLGFGSVLLMVRRGHVGIFFIEGGVPFWGGACFIISGSLSVAAEKNHTSCLVRSSLGTNILSVMAAFAGTAILLMDFGVTNRDVDRGYLAVLTIFTVLEFFTAVIAMHFGCQAIHAQASAPVIFLPNAFSADFNIPSPAASAPPAYDNVAYAQGVV

SEQ ID NO: 11749 - protein, 1053 aa, Artificial Sequence
  Description of Artificial Sequence: Synthetic coding sequence
MEVSGDPGIPALHRLCTRALSASPGPTALGPSTFLPWDVSARMTSARRRTDVGPRVAFTYPCTQLSPTRAHRHLPVHTVTYPCTQLSPTRAHSCHLPMHTVTYPCTPSPTRAHSCHLPVHTVTYTCTLSPTHACLHASTVSCLCCIPVHTVTYPCTLSPTCAHCHLHMRARTHPQPHACAVYLCILSPTRAHCHLHVHTVTYMCVPACTHSITPVHAPPDTSCAWAQAVHRWPVLWGSRSSSMSSGLKQTPMVGVTGPPWDPDAPAPAPAGTLTAHLIPGALQSSGLTLLLSLAAHCSGPQAKVLSPGGLDASGANLWASANCSLLQGFWCQPASQLPRDQLSALIQRLALLQVPLQAWQVSGKECRGAGTGGRGDDPTCGKRGREVGGDWGLRPPQRGRAPTGCHGESRVTRERRSAQLSCLANLASRCGLQDDFTLHPPNLLLFYNLSQVREADCRAFIRRAAQGDVELLSHLPDQRVALWRAAVACLVGAGWGWARCIGGSLPLGADLLALQGVARLRLSASDQQLLGALVCDMDASSIGAADPHMLENLRRCPRLTAAQRIALNSLLAGGKTSLGPPGSWTLEGLQALGPLATYISPHLWAQVQEAVGLGFFRSVVASCQVGRLGQREARCFVTSFLESKTKPVSSRPRLSTGNITAATLRDDLFLVHYDCAELESCLDGCILRTNLDTLLQHLLPTECQHVVKAKLAQIYPQGLPEDQLRLITSLVYLYSRTEIGQWSITSQDTVMALLASDVALENQTEAVLQKFLEHNGTVSGALLLAIGGTRLCWMSPHQIQTIHPQELRLAGALDLSSCPQSRKDVLYTKAHETFGSSGTLAAYYRLMRPYLGGSPGGAQPPSPVPPGGAPVEELRHLAHANISMDIDTFTSLNPLELQSLDVGNVTALLGHNVGDLQKARSHPTVRAWLRSLNSSTLGQLGLDASPTSPTGPAHGTRGPPSTTHQVLHLVHTSGLPTNDAQASTSGSLWAPLGYLPLAMALPCSLLCLLHWGTCILVSVDSVASGWLGSQGSGAGKTEVLDSAGRPLGLTGQL

SEQ ID NO: 11750 - protein, 702 aa, Artificial Sequence
  Description of Artificial Sequence: Synthetic coding sequence
MAAAVTIPGPRIGALQSSGLTLLLSLAAHCSGPQAKVLSPGGLDASGANLWASANCSLLQGFWCQPASQLPRDQLSALIQRLALLQVPLQAWQLSCLANLASRCGLQDDFTLHPPNLLLFYNLSQVREADCRAFIRRAAQGDVELLSHLPDQRVALWRAAVACLVGAGLRLSASDQQLLGALVCDMDASSIGAADPHMLENLRRCPRLTAAQRIALNSLLAGGKTSLGPPGSWTLEGLQALGPLATYISPHLWAQVQEAVGLGFFRSVVASCQVGRLGQREARCFVTSFLESKTKPVSSRPRLSTGNITAATLRDDLFLVHYDCAELESCLDGCILRTNLDTLLQHLLPTECQHVVKAKLAQIYPQGLPEDQLRLITSLVYLYSRTEIGQWSITSQDTVMALLASDVALENQTEAVLQKFLEHNGTVSGALLLAIGGTRLCWMSPHQIQTIHPQELRLAGALDLSSCPQSRKDVLYTKAHETFGSSGTLAAYYRLMRPYLGGSPGGAQPPSPVPPGGAPVEELRHLAHANISMDIDTFTSLNPLELQSLDVGNVTALLGHNVGDLQKARSHPTVRAWLRSLNSSTLGQLGLDASPTSPTGPAHGTRGPPSTTHQVLHLVHTSGLPTNDAQASTSGSLWAPLGYLPLAMALPCSLLCLLHWGTCILVSVDSVASGWLGSQGSGAGKTEVLDSAGRPLGLTGQL

SEQ ID NO: 11751 - protein, 263 aa, Artificial Sequence
  Description of Artificial Sequence: Synthetic coding sequence
MSLVAEAFVSQIAAAEPWPENATLYQQLKGEQILLSDNAASLAVQAFLQMCNLPIKVVCRANAEYMSPSGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 11752 - protein, 253 aa, Artificial Sequence
  Description of Artificial Sequence: Synthetic coding sequence
MYIAAEPWPENATLYQQLKGEQILLSDNAASLAVQAFLQMCNLPIKVVCRANAEYMSPSGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 11753 - protein, 158 aa, Artificial Sequence
  Description of Artificial Sequence: Synthetic coding sequence
MAAPLELSCWGGGWGLPSVHSESLVVMAYAKFSGAPLKVNVIDNTWRGSRGDVPILTTEDDMVSQPAKILNFLRKQKYNADYELSAKQGADTLAYIALLEEKLLPAVLHTFWVESDNYFTVTKPWFASQIPFPLSLILPGRMSKQILSSRAGTHMLRK

SEQ ID NO: 11754 - protein, 248 aa, Artificial Sequence
  Description of Artificial Sequence: Synthetic coding sequence
MAAPLELSCWGGGWGLPSVHSESLVVMAYAKFSGAPLKVNVIDNTWRGSRGDVPILTTEDDMVSQPAKILNFLRKQKYNADYELSAKQGADTLAYIALLEEKLLPAVLHTFWVESDNYFTVTKPWFASQIPFPLSLILPGRMSKGALNRILLTRGQPPLYHLREVEAQIYRDAKECLNLLSNRLGTSQFFFGDTPSTLDAYVFGFLAPLYKVRFPKVQLQEHLKQLSNLCRFCDDILSSYFRLSLGEG

SEQ ID NO: 11755 - protein, 248 aa, Artificial Sequence
  Description of Artificial Sequence: Synthetic coding sequence
MAAPLELSCWGGGWGLPSVHSESLVVMAYAKFSGAPLKVNVIDNTWRGSRGDVPILTTEDDMVSQPAKILNFLRKQKYNADYELSAKQGADTLAYIALLEEKLLPAVLHTFWVESDNYFTVTKPWFASQIPFPLSLILPGRMSKGALNRILLTRGQPPLYHLREVEAQIYRDAKECLNLLSNRLGTSQFFFGDTPSTLDAYVFGFLAPLYKVRFPKVQLQEHLKQLSNLCRFCDDILSSYFRLSLGDG

SEQ ID NO: 11756 - protein, 312 aa, Artificial Sequence
  Description of Artificial Sequence: Synthetic coding sequence
MAAPLELSCWGGGWGLPSVHSESLVVMAYAKFSGAPLKVNVIDNTWRGSRGDVPILTTEDDMVSQPAKILNFLRKQKYNADYELSAKQGADTLAYIALLEEKLLPAVLHTFWVESDNYFTVTKPWFASQIPFPLSLILPGRMSKGALNRILLTRGQPPLYHLREVEAQIYRDAKECLNLLSNRLGTSQFFFGDTPSTLDAYVFGFLAPLYKVRFPKVQLQEHLKQLSNLCRFCDDILSSYFRLSLGGISPAGQETVDANLQKLTQLVNKESNLIEKMDDNLRQSPQLPPRKLPTLKLTPAEEENNSFQRLSP

SEQ ID NO: 11757 - protein, 251 aa, Artificial Sequence
  Description of Artificial Sequence: Synthetic coding sequence
MVSQPAKILNFLRKQKYNADYELSAKQGADTLAYIALLEEKLLPAVLHTFWVESDNYFTVTKPWFASQIPFPLSLILPGRMSKGALNRILLTRGQPPLYHLREVEAQIYRDAKECLNLLSNRLGTSQFFFGDTPSTLDAYVFGFLAPLYKVRFPKVQLQEHLKQLSNLCRFCDDILSSYFRLSLGGISPAGQETVDANLQKLTQLVNKESNLIEKMDDNLRQSPQLPPRKLPTLKLTPAEEENNSFQRLSP

SEQ ID NO: 11758 - protein, 335 aa, Artificial Sequence
  Description of Artificial Sequence: Synthetic coding sequence
MAAPSGVHLLVRRGSHRIFSSPLNHIYLHKQSSSQQRRNFFFRRQRDISHSIVLPAAVSSAHPVPKHIKKPDYVTTGIVPDWGDSIEVKNEDQIQGLHQACQLARHVLLLAGKSLKVDMTTEEIDALVHREIISHNAYPSPLGYGGFPKSVCTSVNNVLCHGIPDSRPLQDGDIINIDVTVYYNGYHGDTSETFLVGNVDECGKKLVEVARRCRDEAIAACRAGAPFSVIGNTISHITHQNGFQVCPHFVGHGIGSYFHGHPEIWHHANDSDLPMEEGMAFTIEPIITEGSPEFKVLEDAWTVVSLDNQRSAQFEHTVLITSRGAQILTKLPHEA

SEQ ID NO: 11759 - protein, 248 aa, Artificial Sequence
  Description of Artificial Sequence: Synthetic coding sequence
MKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 11760 - protein, 186 aa, Artificial Sequence
  Description of Artificial Sequence: Synthetic coding sequence
MCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 11761 - protein, 350 aa, Artificial Sequence
  Description of Artificial Sequence: Synthetic coding sequence
MAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 11762 - protein, 293 aa, Artificial Sequence
  Description of Artificial Sequence: Synthetic coding sequence
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 11763 - protein, 162 aa, Artificial Sequence
  Description of Artificial Sequence: Synthetic coding sequence
MPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 11764 - protein, 85 aa, Artificial Sequence
  Description of Artificial Sequence: Synthetic coding sequence
MATNESVSIFSSASLAVEYVDSLLPENPLQEPFKNAWNYMLNNYTKFQIATWGSLIVHEALYFLFCLPGFLFQFIPYMKKYKIQK

SEQ ID NO: 11765 - protein, 220 aa, Artificial Sequence
  Description of Artificial Sequence: Synthetic coding sequence
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIR

SEQ ID NO: 11766 - protein, 240 aa, Artificial Sequence
  Description of Artificial Sequence: Synthetic coding sequence
MAALRRMLHLPSLMMGTCRPFAGSLADSCLADRCLWDRLHAQPRLGTVPTFDWFFGYDEVQGLLLPLLQEAQAASPLRVLDVGCGTSSLCTGLYTKSPHPVDVLGVDFSPVAVAHMNSLLEGGPGQTPLCPGHPASSLHFMHADAQNLGAVASSGSFQLLLDKGTWDAVARGGLPRAYQLLSECLRVLNPQGTLIQFSDEDPDVRLPCLEQGSYGWTVTVQELGPFRGITYFAYLIQGSH

SEQ ID NO: 11767 - protein, 218 aa, Artificial Sequence
  Description of Artificial Sequence: Synthetic coding sequence
MALVPYEETTEFGLQKFHKPLATFSFANHTIQIRQDWRHLGVAAVVWDAAIVLSTYLEMGAVELRGRSAVELGAGTGLVGIVAALLGAHVTITDRKVALEFLKSNVQANLPPHIQTKTVVKELTWGQNLGSFSPGEFDLILGADIIYLEETFTDLLQTLEHLCSNHSVILLACRIRYERDNNFLAMLERQFTVRKVHYDPEKDVHIYEAQKRNQKEDL

SEQ ID NO: 11768 - protein, 218 aa, Artificial Sequence; identical to SEQ ID NO: 11767
  Description of Artificial Sequence: Synthetic coding sequence

SEQ ID NO: 11769 - protein, 90 aa, Artificial Sequence
  Description of Artificial Sequence: Synthetic coding sequence
MALVPYEETTEFGLQKFHKPLATFSFANHTIQIRQDWRHLGVAAVVWDAAIVLSTYLEMGAVELRGRSAVELGAGTGLVGIVAALLGGGI

SEQ ID NO: 11770 - protein, 218 aa, Artificial Sequence; identical to SEQ ID NO: 11767
  Description of Artificial Sequence: Synthetic coding sequence

SEQ ID NO: 11771 - protein, 218 aa, Artificial Sequence; identical to SEQ ID NO: 11767
  Description of Artificial Sequence: Synthetic coding sequence

SEQ ID NO: 11772 - protein, 218 aa, Artificial Sequence; identical to SEQ ID NO: 11767
  Description of Artificial Sequence: Synthetic coding sequence

SEQ ID NO: 11773 - protein, 90 aa, Artificial Sequence; identical to SEQ ID NO: 11769
  Description of Artificial Sequence: Synthetic coding sequence

SEQ ID NO: 11774 - protein, 226 aa, Artificial Sequence
  Description of Artificial Sequence: Synthetic coding sequence
MADPGPDPESESESVFPREVGLFADSYSEKSQFCFCGHVLTITQNFGSRLGVAARVWDAALSLCNYFESQNVDFRGKKVIELGAGTGIVGILAALQGGDVTITDLPLALEQIQGNVQANVPAGGQAQVRALSWGIDHHVFPANYDLVLGADIVYLEPTFPLLLGTLQHLCRPHGTIYLASKMRKEHGTESFFQHLLPQHFQLELAQRDEDENVNIYRARHREPRPA

SEQ ID NO: 11775 - protein, 149 aa, Artificial Sequence
  Description of Artificial Sequence: Synthetic coding sequence
MADPGPDPESESESVFPREVGLFADSYSEKSQFCFCGHVLTITQNFGSRLGVAARVWDAALSLCNYFESQNVDFRGKKVIELGAGTGIVGILAALQGAYGLVRETEDDVIEQELWRGMRGACGHALSMSTMTPWESIKGSSVRGGCYHH

SEQ ID NO: 11776 - protein, 269 aa, Artificial Sequence
  Description of Artificial Sequence: Synthetic coding sequence
ARCQFCACESLSPCSGLSSLAARQGYHQIWAFPFLPSGATATWPAASRSRSLAARSLPRSPARPGPNDALLGEHDFRGQGVRAQRFRFSEEPGPGADGAVLEVHVPQIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 11777 - protein, 190 aa, Artificial Sequence
  Description of Artificial Sequence: Synthetic coding sequence
MYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 11778 - protein, 123 aa, Artificial Sequence
  Description of Artificial Sequence: Synthetic coding sequence
MNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 11779 - protein, 123 aa, Artificial Sequence; identical to SEQ ID NO: 11778
  Description of Artificial Sequence: Synthetic coding sequence

SEQ ID NO: 11780 - protein, 123 aa, Artificial Sequence; identical to SEQ ID NO: 11778
  Description of Artificial Sequence: Synthetic coding sequence

SEQ ID NO: 11781 - protein, 904 aa, Artificial Sequence
  Description of Artificial Sequence: Synthetic coding sequence
MAAIRALQQWCRQQCEGYRDVNICNMTTSFRDGLAFCAILHRHRPDLINFSALKKENIYENNKLAFRVAEEHLGIPALLDAEDMVALKVPDRLSILTYVSQYYNYFHGRSPIGGMAGVKRASEDSEEEPSGKKAPVQAAKLPSPAPARKPPLSPAQTNPVVQRRNEGAGGPPPKTDQALAGSLVSSTCGVCGKHVHLVQRHLADGRLYHRSCFRCKQCSCTLHSGAYKATGEPGTFVCTSHLPAAASASPKLTGLVPRQPGAMGVDSRTSCSPQKAQEANKARPSAWEPAAGNSPARASVPAAPNPAATSATSVHVRSPARPSESRLAPTPTEGKVRPRVTNSSPMGWSSAAPCTAAAASHPAVPPSAPDPRPATPQGGGAPRVAAPQTTLSSSSTSAATVDPPAWTPSASRTQQARNKFFQTSAVPPGTSLSGRGPTPSLVLSKDSSKEQARNFLKQALSALEEAGAPAPGRPSPATAAVPSSQPKTEAPQASPLAKPLQSSSPRVLGLPSRMEPPAPLSTSSTSQASALPPAGRRNLAESSGVGRVGAGSRPKPEAPMAKGKSTTLTQDMSTSLQEGQEDGPAGWRANLKPVDRRSPAERTLKPKEPRALAEPRAGEAPRKVSGSFAGSVHITLTPVRPDRTPRPASPGPSLPARSPSPPRRRRLAVPASLDVCDNWLRPEPPGQEARVQSWKEEEKKPHLQGKPGRPLSPANVPALPGETVTSPVRLHPDYLSPEEIQRQLQDIERRLDALELRGVELEKRLRAAEGDDAEDSLMVDWFWLIHEKQLLLRQESELMYKSKAQRLEEQQLDIEGELRRLMAKPEALKSLQERRREQELLEQYVSTVNDRSDIVDSLDEDRLREQEEDQMLRDMIEKLGLQRKKSKFRLSKIWSPKSKSSPSQ

SEQ ID NO: 11782 - protein, 692 aa, Artificial Sequence
  Description of Artificial Sequence: Synthetic coding sequence
MAAIRALQQWCRQQCEGYRDVNICNMTTHLPAAASASPKLTGLVPRQPGAMGVDSRTSCSPQKAQEANKARPSAWEPAAGNSPARASVPAAPNPAATSATSVHVRSPARPSESRLAPTPTEGKVRPRVTNSSPMGWSSAAPCTAAAASHPAVPPSAPDPRPATPQGGGAPRVAAPQTTLSSSSTSAATVDPPAWTPSASRTQQARNKFFQTSAVPPGTSLSGRGPTPSLVLSKDSSKEQARNFLKQALSALEEAGAPAPGRPSPATAAVPSSQPKTEAPQASPLAKPLQSSSPRVLGLPSRMEPPAPLSTSSTSQASALPPAGRRNLAESSGVGRVGAGSRPKPEAPMAKGKSTTLTQDMSTSLQEGQEDGPAGWRANLKPVDRRSPAERTLKPKEPRALAEPRAGEAPRKVSGSFAGSVHITLTPVRPDRTPRPASPGPSLPARSPSPPRRRRLAVPASLDVCDNWLRPEPPGQEARVQSWKEEEKKPHLQGKPGRPLSPANVPALPGETVTSPVRLHPDYLSPEEIQRQLQDIERRLDALELRGVELEKRLRAAEGDDAEDSLMVDWFWLIHEKQLLLRQESELMYKSKAQRLEEQQLDIEGELRRLMAKPEALKSLQERRREQELLEQYVSTVNDRSDIVDSLDEDRLREQEEDQMLRDMIEKLGLQRKKSKFRLSKIWSPKSKSSPSQ

SEQ ID NO: 11783 - protein, 409 aa, Artificial Sequence
  Description of Artificial Sequence: Synthetic coding sequence
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 11784 - protein, 306 aa, Artificial Sequence
  Description of Artificial Sequence: Synthetic coding sequence
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 11785 - protein, 64 aa, Artificial Sequence
  Description of Artificial Sequence: Synthetic coding sequence
MHDSGLLNITKVSFSDRGKYTCVASNIYGTVNNTVTLRVIFTSGDMGVYYMVVCLVAFTIVMVL

SEQ ID NO: 11786 - protein, 98 aa, Artificial Sequence
  Description of Artificial Sequence: Synthetic coding sequence
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERG

SEQ ID NO: 11787 - protein, 90 aa, Artificial Sequence
  Description of Artificial Sequence: Synthetic coding sequence
MDRLKSHLTVCFLPSVPFLILVSTLATAKSVTNSTLNGTNVVLGSVPVIIARTDHIIVKEGNSALINCSVYGIPDPQFKWYNSIGKLLKE

SEQ ID NO: 11788 - protein, 73 aa, Artificial Sequence
  Description of Artificial Sequence: Synthetic coding sequence
MDRLKSHLTVCFLPSVPFLILVSTLATAKSVTNSTLNGTNVVLGSVPVIIARTDHIIVKEGNSALINCSVYGI

SEQ ID NO: 11789 - protein, 157 aa, Artificial Sequence
  Description of Artificial Sequence: Synthetic coding sequence
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEV

SEQ ID NO: 11790 - protein, 121 aa, Artificial Sequence
  Description of Artificial Sequence: Synthetic coding sequence
MPSDRPFKQRRSFADRCKEVQQIRDQHPSKIPVIIERYKGEKQLPVLDKTKFLVPDHVNMSELVKIIRRRLQLNPTQAFFLLVNQHSMVSVSTPIADIYEQEKDEDGFLYMVYASQETFGF

SEQ ID NO: 11791 - protein, 121 aa, Artificial Sequence; identical to SEQ ID NO: 11790
  Description of Artificial Sequence: Synthetic coding sequence

SEQ ID NO: 11792 - protein, 125 aa, Artificial Sequence
  Description of Artificial Sequence: Synthetic coding sequence
MKMRFFSSPCGKAAVDPADRCKEVQQIRDQHPSKIPVIIERYKGEKQLPVLDKTKFLVPDHVNMSELVKIIRRRLQLNPTQAFFLLVNQHSMVSVSTPIADIYEQEKDEDGFLYMVYASQETFGF

SEQ ID NO: 11793 - protein, 125 aa, Artificial Sequence
  Description of Artificial Sequence: Synthetic coding sequence
MPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVYASQETFGMKLSV

SEQ ID NO: 11794 - protein, 66 aa, Artificial Sequence
  Description of Artificial Sequence: Synthetic coding sequence
MSELIKIIRRRLQLNANQAFFLLVNGHSMVSVSTPISEVYESEKDEDGFLYMVYASQETFGMKLSV

SEQ ID NO: 11795 - protein, 147 aa, Artificial Sequence
  Description of Artificial Sequence: Synthetic coding sequence
MPPPQKIPSVRPFKQRKSLAIRQEEVAGIRAKFPNKIPVVVERYPRETFLPPLDKTKFLVPQELTMTQFLSIIRSRMVLRATEAFYLLVNNKSLVSMSATMAEIYRDYKDEDGFVYMTYASQETFGCLESAAPRDGSSLEDRPCNPL

SEQ ID NO: 11796 - protein, 655 aa, Artificial Sequence
  Description of Artificial Sequence: Synthetic coding sequence
MAELGAGGDGHRGGDGAVRSETAPDSYKVQDKKNASSRPASAISGQNNNHSGNKPDPPPVLRVDDRQRLARERREEREKQLDPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAVVI

SEQ ID NO: 11797 - protein, 749 aa, Artificial Sequence
  Description of Artificial Sequence: Synthetic coding sequence
MAELGAGGDGHRGGDGAVRSETAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 11798 - protein, 603 aa, Artificial Sequence
  Description of Artificial Sequence: Synthetic coding sequence
MERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 11799 - protein, 734 aa, Artificial Sequence
  Description of Artificial Sequence: Synthetic coding sequence
MPGSATALRHERLKKTNARPIPLGLFTINEEDEQQKNGNSRRPKAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSAARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 11800 - protein, 771 aa, Artificial Sequence
  Description of Artificial Sequence: Synthetic coding sequence
MPGSATALRHERLKKTNARPIPLGLFTINEEDEQQKNGNSRRPKAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 11801 - protein, 734 aa, Artificial Sequence
  Description of Artificial Sequence: Synthetic coding sequence
MEDTKLYSPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 11802 - protein, 1006 aa, Artificial Sequence
  Description of Artificial Sequence: Synthetic coding sequence
MSNSRNNRVMVEGVGARVVRGPDWKWGKQDGGEGHVGTVRSFESPEEVVVVWDNGTAANYRCSGAYDLRILDSAPTGIKHDGTMCDTCRQQPIIGIRWKCAECTNYDLCTVCYHGDKHHLRHRFYRITTPGSERVLLESRRKSKKITARGIFAGARVVRGVDWQWEDQDGGNGRRGKVTEIQDWSASSPHSAAYVLWDNGAKNLYRVGFEGMSDLKCVQDAKGGSFYRDHCPVLGEQNGNRNPGGLQIGDLVNIDLDLEIVQSLQHGHGGWTDGMFETLTTTGTVCGIDEDHDIVVQYPSGNRWTFNPAVLTKANIVRSGDAAQGAEGGTSQFQVGDLVQVCYDLERIKLLQRGHGEWAEAMLPTLGKVGRVQQIYSDSDLKVEVCGTSWTYNPAAVSKVASAGSAISNASGERLSQLLKKLFETQESGDLNEELVKAAANGDVAKVEDLLKRPDVDVNGQCAGHTAMQAASQNGHVDILKLLLKQNVDVEAEDKDGDRAVHHAAFGDEGAVIEVLHRGSADLNARNKRRQTPLHIAVNKGHLQVVKTLLDFGCHPSLQDSEGDTPLHDAISKKRDDILAVLLEAGADVTITNNNGFNALHHAALRGNPSAMRVLLSKLPRPWIVDEKKDDGYTALHLAALNNHVEVAELLVHQGNANLDIQNVNQQTALHLAVERQHTQIVRLLVRAGAKLDIQDKDGDTPLHEALRHHTLSQLRQLQDMQDVGKVDAAWEPSKNTLIMGLGTQGAEKKSAASIACFLAANGADLSIRNKKGQSPLDLCPDPNLCKALAKCHKEKVSGQVGSRSPSMISNDSETLEECMVCSDMKRDTLFGPCGHIATCSLCSPRVKKCLICKEQVQSRTKIEECVVCSDKKAAVLFQPCGHMCACENCANLMKKCVQCRAVVERRVPFIMCCGGKSSEDATDDISSGNIPVLQKDKDNTNVNADVQKLQQQLQDIKEQTMCPVCLDRLKNMIFLCGHGTCQLCGDRMSECPICRKAIERRILLY

SEQ ID NO: 11803 - protein, 249 aa, Artificial Sequence
  Description of Artificial Sequence: Synthetic coding sequence
MAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQSRFSLGYCDFDLRPCHETTVDIFHKKHTKNI

SEQ ID NO: 11804 - protein, 231 aa, Artificial Sequence
  Description of Artificial Sequence: Synthetic coding sequence
LKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQSRFSLGYCDFDLRPCHETTVDIFHKKHTKNI

SEQ ID NO: 11805 - protein, 476 aa, Artificial Sequence
  Description of Artificial Sequence: Synthetic coding sequence
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 11806 - protein, 478 aa, Artificial Sequence
  Description of Artificial Sequence: Synthetic coding sequence
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKNKKISQEREKFADEGSIFYTLGECGLISFSDYIFLTTVLSTPQRNFEIAFKMFDLNGDGEVDMEEFEQAISIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 11807 - protein, 278 aa, Artificial Sequence
  Description of Artificial Sequence: Synthetic coding sequence
MVSLKAKLNHLRQSMLKQKAPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 11808 - protein, 476 aa, Artificial Sequence
  Description of Artificial Sequence: Synthetic coding sequence
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQAISIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 11809 - protein, 278 aa, Artificial Sequence
  Description of Artificial Sequence: Synthetic coding sequence
MKRIYTYRRAKEIFKDTPKAPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 11810 - protein, 363 aa, Artificial Sequence
  Description of Artificial Sequence: Synthetic coding sequence
MDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSCFSAGCHQDHALPWSNLNHLKNTVSTWPPWVRPDHLGTPARRLQPNNNQMCSSPAGLQFHICHVSVQMWG

SEQ ID NO: 11811 - protein, 357 aa, Artificial Sequence
  Description of Artificial Sequence: Synthetic coding sequence
MDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVIQPGPGHPELYQVRDGDCSEHADLPLPASWRPHGCEQLRAASWAPPLLPSVQILDSLLEVPECAACFSAGCHQDHALPWSNLNHLKNTVSTWPPWVRPDHLGTPARRLQPNNNQMCSSPAGLQFHICHVSVQMWG

SEQ ID NO: 11812 - protein, 186 aa, Artificial Sequence
  Description of Artificial Sequence: Synthetic coding sequence
AVCVPHVGPPPACHLNALHGPVCGTGGQVQLSCGATIPGSSAAMVPHFGVINGKLAHSPRLIMSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVASSSEAPACFSAGCHQDHALP

SEQ ID NO: 11813 - protein, 372 aa, Artificial Sequence
  Description of Artificial Sequence: Synthetic coding sequence
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 11814 - protein, 389 aa, Artificial Sequence
  Description of Artificial Sequence: Synthetic coding sequence
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 11815 - protein, 201 aa, Artificial Sequence
  Description of Artificial Sequence: Synthetic coding sequence
  MOD_RES (1)..(1): Any amino acid
XAVCVPHVGPPPACHLNALHGPVCGTGGQVQLSCGATIPGSSAAMVPHFGVINGKLAHSPRLIMSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFA

SEQ ID NO: 11816 - protein, 394 aa, Artificial Sequence
  Description of Artificial Sequence: Synthetic coding sequence
AGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQVSKHWTAEAFPVLCYILQLKWFCGCFIACKDKWFHGIQYCEEILGIYKAFKFSSYIISERI

SEQ ID NO: 11817 - protein, 254 aa, Artificial Sequence
  Description of Artificial Sequence: Synthetic coding sequence
MSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQVSKHWTAEAFPVLCYILQLKWFCGCFIACKDKWFHGIQYCEEILGIYKAFKFSSYIISERI

SEQ ID NO: 11818 - protein, 297 aa, Artificial Sequence
  Description of Artificial Sequence: Synthetic coding sequence
MMDSEAHEKRPPILTSSKQDISPHITNVGEMKHYLCGCCAAFNNVAITFPIQKVLFRQQLYGIKTRDAILQLRRDGFRNLYRGILPPLMQKTTTLALMFGLYEDLSCLLHKHVSAPEFATSGVAAVLAGTTEAIFTPLERVQTLLQDHKHHDKFTNTYQAFKALKCHGIGEYYRGLVPILFRNGLSNVLFFGLRGPIKEHLPTATTHSAHLVNDFICGGLLGAMLGFLFFPINVVKTRIQSQIGGEFQSFPKVFQKIWLERDRKLINLFRGAHLNYHRSLISWGIINATYEFLLKVI

SEQ ID NO: 11819 - protein, 297 aa, Artificial Sequence; identical to SEQ ID NO: 11818
  Description of Artificial Sequence: Synthetic coding sequence

SEQ ID NO: 11820 - protein, 297 aa, Artificial Sequence; identical to SEQ ID NO: 11818
  Description of Artificial Sequence: Synthetic coding sequence

SEQ ID NO: 11821 - protein, 307 aa, Artificial Sequence
  Description of Artificial Sequence: Synthetic coding sequence
MPFMRKILSNMIDSEAHEKRPPILTSSKQDISPHITNVGEMKHYLCGCCAAFNNVAITYPIQKVLFRQQLYGIKTRDAVLQLRRDGFRNLYRGILPPLMQKTTTLALMFGLYEDLSCLLRKHVRAPEFATHGVAAVLAGTAEAIFTPLERVQTLLQNHKHHDKFTNTYQAFKALKCHGIGEYYRGLVPILFRNGLSNVLFFGLRGPIKEHLPTATTHSAHLVNDFIGGGLLGAMLGFLCFPINVVKTRLQSQIGGEFQSFPKVFQKIWLERDRKLINLFRGAHLNYHRSLISWGIINATYEFLLKFI

SEQ ID NO: 11822 - protein, 297 aa, Artificial Sequence
  Description of Artificial Sequence: Synthetic coding sequence
MIDSEAHEKRPPILTSSKQDISPHITNVGEMKHYLCGCCAAFNNVAITYPIQKVLFRQQLYGIKTRDAVLQLRRDGFRNLYRGILPPLMQKTTTLALMFGLYEDLSCLLRKHVRAPEFATHGVAAVLAGTAEAIFTPLERVQTLLQNHKHHDKFTNTYQAFKALKCHGIGEYYRGLVPILFRNGLSNVLFFGLRGPIKEHLPTATTHSAHLVNDFIGGGLLGAMLGFLCFPINVVKTRLQSQIGGEFQSFPKVFQKIWLERDRKLINLFRGAHLNYHRSLISWGIINATYEFLLKFI

SEQ ID NO: 11823 - protein, 307 aa, Artificial Sequence
  Description of Artificial Sequence: Synthetic coding sequence
MGEQNHSPGKELQHRTRAEAPGKKSWHSQAYALGAVSNFMSTFLTFPIYKVVFRQQIHAMAVSEAVRQLWHEGPQYFYRGIYPPLLSKTLQGTLLFGTYDSLLCFLSPVGPHTLGHRWAAGLMSGVVEAVALSPFERVQNVLQDGRKQARFPSTFSILKEFNSYGLWGRLSLGYYRGFWPVLARNSLGSALYFSFKDPIQDGLAEQGLPHWVPALVSGSVNGTITCLVLYPLIVLVANMQSHIGWQNMPSLWASAQDVWNTRGRKLLLIYRGGSLVILRSSVTWGLTTAIHDFLQRKSHSRKELKTD

SEQ ID NO: 11824 - protein, 291 aa, Artificial Sequence
  Description of Artificial Sequence: Synthetic coding sequence
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 11825 - protein, 243 aa, Artificial Sequence
  Description of Artificial Sequence: Synthetic coding sequence
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTYGISNIDTTIEGTSDDLTVVDAASLRRQIIKLNRRLQLLEEENKERAKREMVMYSITVAFWLLNSWLWFRR

SEQ ID NO: 11826 - protein, 238 aa, Artificial Sequence
  Description of Artificial Sequence: Synthetic coding sequence
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 11827 - protein, 342 aa, Artificial Sequence
  Description of Artificial Sequence: Synthetic coding sequence
MSKGTSSDTSLGRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 11828 - protein, 218 aa, Artificial Sequence
  Description of Artificial Sequence: Synthetic coding sequence
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 11829 - protein, 342 aa, Artificial Sequence; identical to SEQ ID NO: 11827
  Description of Artificial Sequence: Synthetic coding sequence

SEQ ID NO: 11830 - protein, 218 aa, Artificial Sequence; identical to SEQ ID NO: 11828
  Description of Artificial Sequence: Synthetic coding sequence

SEQ ID NO: 11831 - protein, 238 aa, Artificial Sequence; identical to SEQ ID NO: 11826
  Description of Artificial Sequence: Synthetic coding sequence

SEQ ID NO: 11832 - protein, 60 aa, Artificial Sequence
  Description of Artificial Sequence: Synthetic coding sequence
MAEISRIQYEMEYTEGISQRMRVPEKLKVAPPNADLEQGFQEGVPNASVIMQVPERIVVA

SEQ ID NO: 11833 - protein, 32 aa, Artificial Sequence
  Description of Artificial Sequence: Synthetic coding sequence
MAEISRIQYEMEYTEGISQRMRVPEKLKVAPP

SEQ ID NO: 11834 - protein, 34 aa, Artificial Sequence
  Description of Artificial Sequence: Synthetic coding sequence
MSKGTSSDTSLGRVSRAAFPSPTAAEMAEISRIQ

SEQ ID NO: 11835 - protein, 71 aa, Artificial Sequence
  Description of Artificial Sequence: Synthetic coding sequence
MSKGTSSDTSLGRVSRAAFPSPTAAEMAEISRIQYEMEYTEGISQRMRVPEKLKVAPPNADLEQGFQEGVP

SEQ ID NO: 11836 - protein, 138 aa, Artificial Sequence
  Description of Artificial Sequence: Synthetic coding sequence
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQN

SEQ ID NO: 11837 - protein, 52 aa, Artificial Sequence
  Description of Artificial Sequence: Synthetic coding sequence
MAEISRIQYEMEYTEGISQRMRVPEKLKVAPPNADLEQGFQEGVPNASVIMQ

SEQ ID NO: 11838 - protein, 166 aa, Artificial Sequence
  Description of Artificial Sequence: Synthetic coding sequence
MSEPQPRGAERDLYRDTWVRYLGYANEVGEAFRSLVPAAVVWLSYGVASSYVLADAIDKGKKAGEVPSPEAGRSARVTVAVVDTFVWQALASVAIPGFTINRVCAASLYVLGTATRWPLAVRKWTTTALGLLTIPIIIHPIDRSVDFLLDSSLRKLYPTVGKPSSS

SEQ ID NO: 11839 - protein, 135 aa, Artificial Sequence
  Description of Artificial Sequence: Synthetic coding sequence
MSEPQPRGAERDLYRDTWVRYLGYANEVGEAFRSLVPAAVVWLSYGVASSYVLADAIDKGKKAGEVGGFPPGLQPAQALPNSGEAQLLLIILWYLACASASCFMSTSYSCQGMWTPGSLVSKDPGTWVGLSWTEA

SEQ ID NO: 11840 - protein, 333 aa, Artificial Sequence
  Description of Artificial Sequence: Synthetic coding sequence
MLGWIKRLIRMVFQQVGVSMQSVLWSRKPYGSSRSIVRKIGTNLSLIQCPRVQFQINSHATEWSPSHPGEDAVASFADVGWVAKEEGECSARLRTEVRSRPPLQDDLLFFEKAPSRQISLPDLSQEEPQLKTPALANEEALQKICALENELAALRAQIAKIVTQQEQQNLTAGDLDSTTFGTIPPHPPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLFGPHMLKPTGKMKALIENVSDS

SEQ ID NO: 11841 - protein, 300 aa, Artificial Sequence
  Description of Artificial Sequence: Synthetic coding sequence
MLGWIKRLIRMVFQQVGVSMQSINSHATEWSPSHPGEDAVASFADVGWVAKEEGECSARLRTEVRSRPPLQDDLLFFEKAPSRQISLPDLSQEEPQLKTPALANEEALQKICALENELAALRAQIAKIVTQQEQQNLTAGDLDSTTFGTIPPHPPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLFGPHMLKPTGKMKALIENVSDS

SEQ ID NO: 11842 - protein, 334 aa, Artificial Sequence
  Description of Artificial Sequence: Synthetic coding sequence
MRLTPRALCSAAQAAWRENFPLCGRDVARWFPGHMAKGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGKATRVGGEPGITRAVMSKIQVSERPLMFLLDTPGVLAPRIESVETGLKLALCGTVLDHLVGEETMADYLLYTLNKHQRFGYVQHYGLGSACDNVERVLKSVAVKLGKTQKVKVLTGTGNVNIIQPNYPAAARDFLQTFRRGLLGSVMLDLDVLRGHPPAETLP

SEQ ID NO: 11843 - protein, 283 aa, Artificial Sequence
  Description of Artificial Sequence: Synthetic coding sequence
MRLTPRALCSAAQAAWRENFPLCGRDVARWFPGHMAKGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKEVSERPLMFLLDTPGVLAPRIESVETGLKLALCGTVLDHLVGEETMADYLLYTLNKHQRFGYVQHYGLGSACDNVERVLKSVAVKLGKTQKVKVLTGTGNVNIIQPNYPAAARDFLQTFRRGLLGSVMLDLDVLRGHPPAETLP

SEQ ID NO: 11844 - protein, 226 aa, Artificial Sequence
  Description of Artificial Sequence: Synthetic coding sequence
MQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGKATRVGGEPGITRAVMSKIQVESSGARPSTLSRALQASGTCRPLCGFRLLTTLPSPPLSVPAEHPRGRHCPCPYSTVVIVFAPNLWGRHAVFPISR

SEQ ID NO: 11845 - protein, 78 aa, Artificial Sequence
  Description of Artificial Sequence: Synthetic coding sequence
MSESELGRKWDRCLADAVVKIGTGFGLGIVFSLTFFKRRMWPLAFGSGMGLGMAYSNCQHDFQAPYLLHGKYVKEQEQ

SEQ ID NO: 11846 - protein, 488 aa, Artificial Sequence
  Description of Artificial Sequence: Synthetic coding sequence
MNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESVPGKQWKGQFTTVRKSGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 11847 - protein, 567 aa, Artificial Sequence
  Description of Artificial Sequence: Synthetic coding sequence
MTFYLFGIRSFPKLWKSPYLGLGPGHSYVSLFLADRCGIRNQQRLFSLKTMSPQNTKATNLIAKARYLRKDEGSNKQVYSVPHFFLAGAAKERSQMNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 11848 - protein, 583 aa, Artificial Sequence
  Description of Artificial Sequence: Synthetic coding sequence
MTFYLFGIRSFPKLWKSPYLGLGPGHSYVSLFLADRCGIRNQQRLFSLKTMSPQNTKATNLIAKARYLRKDEGSNKQVYSVPHFFLAGAAKERSQMNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESVPGKQWKGQFTTVRKSGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 11849 - protein, 34 aa, Artificial Sequence
  Description of Artificial Sequence: Synthetic coding sequence
MTFYLFGIRSFPKLWKSPYLGLGPGHSYVSLFLA

SEQ ID NO: 11850 - protein, 20 aa, Artificial Sequence
  Description of Artificial Sequence: Synthetic coding sequence
MTFYLFGIRSFPKLWKSPYL

SEQ ID NO: 11851 - protein, 488 aa, Artificial Sequence; identical to SEQ ID NO: 11846
  Description of Artificial Sequence: Synthetic coding sequence

SEQ ID NO: 11852 - protein, 23 aa, Artificial Sequence
  Description of Artificial Sequence: Synthetic coding sequence
MTFYLFGIRSFPKLWKSPYLGLG

SEQ ID NO: 11853 - protein, 567 aa, Artificial Sequence; identical to SEQ ID NO: 11847
  Description of Artificial Sequence: Synthetic coding sequence

SEQ ID NO: 11854 - protein, 211 aa, Artificial Sequence
  Description of Artificial Sequence: Synthetic coding sequence
MRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 11855 - protein, 210 aa, Artificial Sequence
  Description of Artificial Sequence: Synthetic coding sequence
MALGLKCFRMVHPTFRNYLAASIRPVSEVTLKTVHERQHGHRQYMAYSAVPVRHFATKKAKGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 11856 - protein, 262 aa, Artificial Sequence
  Description of Artificial Sequence: Synthetic coding sequence
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 11857 - protein, 201 aa, Artificial Sequence
  Description of Artificial Sequence: Synthetic coding sequence
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQSAKWPMTQWQNWTGIWQ

SEQ ID NO: 11858 - protein, 124 aa, Artificial Sequence
  Description of Artificial Sequence: Synthetic coding sequence
MAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPETMKQIKQYFNGPNVA

SEQ ID NO: 11859 - protein, 158 aa, Artificial Sequence
  Description of Artificial Sequence: Synthetic coding sequence
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPEVRWPC

SEQ ID NO: 11860 - protein, 158 aa, Artificial Sequence; identical to SEQ ID NO: 11859
  Description of Artificial Sequence: Synthetic coding sequence

SEQ ID NO: 11861 - protein, 218 aa, Artificial Sequence
  Description of Artificial Sequence: Synthetic coding sequence
MAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 11862 - protein, 176 aa, Artificial Sequence
  Description of Artificial Sequence: Synthetic coding sequence
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPEELAWIRSLRVPGIRSHLYHQLAV

SEQ ID NO: 11863 - protein, 201 aa, Artificial Sequence; identical to SEQ ID NO: 11857
  Description of Artificial Sequence: Synthetic coding sequence

SEQ ID NO: 11864 - protein, 153 aa, Artificial Sequence
  Description of Artificial Sequence: Synthetic coding sequence
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPE

SEQ ID NO: 11865 - protein, 168 aa, Artificial Sequence
  Description of Artificial Sequence: Synthetic coding sequence
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPETMKQIKQYFNGPNVA

SEQ ID NO: 11866 - protein, 353 aa, Artificial Sequence
  Description of Artificial Sequence: Synthetic coding sequence
MALLSTVRGATWGRLVTRHFSHAARHGERPGGEELSRLLLDDLVPTSRLELLFGMTPCLLALQAARRSVARLLLQAGKAGLQGKRAELLRMAEARDIPVLRPRRQKLDTMCRYQVHQGVCMEVSPLRPRPWREAGEASPGDDPQQLWLVLDGIQDPRNFGAVLRSAHFLGVDKVITSRRNSCPLTPVVSKSSAGAMEVMDVFSTDDLTGFLQTKAQQGWLVAGTVGCPSTEDPQSSEIPIMSCLEFLWERPTLLVLGNEGSGLSQEVQASCQLLLTILPRRQLPPGLESLNVSVAAGILLHSICSQRKGFPTEGERRQLLQDPQEPSARSEGLSMAQHPGLSSGPEKERQNEG

SEQ ID NO: 11867 - protein, 278 aa, Artificial Sequence
  Description of Artificial Sequence: Synthetic coding sequence
MAALFLKRLTLQTVKSENSCIRCFGKHILQKTAPAQLSPIASAPRLSFLIHAKAFSTAEDTQNEGKKTKKNKTAFSNVGRKISQRVIHLFDEKGNDLGNMHRANVIRLMDERDLRLVQRNTSTEPAEYQLMTGLQILQERQRLREMEKANPKTGPTLRKELILSSNIGQHDLDTKTKQIQQWIKKKHLVQITIKKGKNVDVSENEMEEIFHQILQTMPGIATFSSRPQAVQGGKALMCVLRAFSKNEEKAYKETQETQERDTLNKDHGNDKESNVLHQ

SEQ ID NO: 11868 - protein, 278 aa, Artificial Sequence; identical to SEQ ID NO: 11867
  Description of Artificial Sequence: Synthetic coding sequence

SEQ ID NO: 11869 - protein, 278 aa, Artificial Sequence; identical to SEQ ID NO: 11867
  Description of Artificial Sequence: Synthetic coding sequence

SEQ ID NO: 11870 - protein, 278 aa, Artificial Sequence; identical to SEQ ID NO: 11867
  Description of Artificial Sequence: Synthetic coding sequence

SEQ ID NO: 11871 - protein, 226 aa, Artificial Sequence
  Description of Artificial Sequence: Synthetic coding sequence
MNENLFASFIAPTILGLPAAVLIILFPPLLIPTSKYLINNRLITTQQWLIKLTSKQMMTMHNTKGRTWSLMLVSLIIFIATTNLLGLLPHSFTPTTQLSMNLAMAIPLWAGTVIMGFRSKIKNALAHFLPQGTPTPLIPMLVIIETISLLIQPMALAVRLTANITAGHLLMHLIGSATLAMSTINLPSTLIIFTILILLTILEIAVALIQAYVFTLLVSLYLHDNT

SEQ ID NO: 11872 - protein, 380 aa, Artificial Sequence
  Description of Artificial Sequence: Synthetic coding sequence
MTPMRKTNPLMKLINHSFIDLPTPSNISAWWNFGSLLGACLILQITTGLFLAMHYSPDASTAFSSIAHITRDVNYGWIIRYLHANGASMFFICLFLHIGRGLYYGSFLYSETWNIGIILLLATMATAFMGYVLPWGQMSFWGATVITNLLSAIPYIGTDLVQWIWGGYSVDSPTLTRFFTFHFILPFIIAALATLHLLFLHETGSNNPLGITSHSDKITFHPYYTIKDALGLLLFLLSLMTLTLFSPDLLGDPDNYTLANPLNTPPHIKPEWYFLFAYTILRSVPNKLGGVLALLLSILILAMIPILHMSKQQSMMFRPLSQSLYWLLAADLLILTWIGGQPVSYPFTIIGQVASVLYFTTILILMPTISLIENKMLKWA

SEQ ID NO: 11873 - protein, 513 aa, Artificial Sequence
  Description of Artificial Sequence: Synthetic coding sequence
MFADRWLFSTNHKDIGTLYLLFGAWAGVLGTALSLLIRAELGQPGNLLGNDHIYNVIVTAHAFVMIFFMVMPIMIGGFGNWLVPLMIGAPDMAFPRMNNMSFWLLPPSLLLLLASAMVEAGAGTGWTVYPPLAGNYSHPGASVDLTIFSLHLAGVSSILGAINFITTIINMKPPAMTQYQTPLFVWSVLITAVLLLLSLPVLAAGITMLLTDRNLNTTFFDPAGGGDPILYQHLFWFFGHPEVYILILPGFGMISHIVTYYSGKKEPFGYMGMVWAMMSIGFLGFIVWAHHMFTVGMDVDTRAYFTSATMIIAIPTGVKVFSWLATLHGSNMKWSAAVLWALGFIFLFTVGGLTGIVLANSSLDIVLHDTYYVVAHFHYVLSMGAVFAIMGGFIHWFPLFSGYTLDQTYAKIHFTIMFIGVNLTFFPQHFLGLSGMPRRYSDYPDAYTTWNILSSVGSFISLTAVMLMIFMIWEAFASKRKVLMVEEPSMNLEWLYGCPPPYHTFEEPVYMKS

SEQ ID NO: 11874 - protein, 227 aa, Artificial Sequence
  Description of Artificial Sequence: Synthetic coding sequence
MAHAAQVGLQDATSPIMEELITFHDHALMIIFLICFLVLYALFLTLTTKLTNTNISDAQEMETVWTILPAIILVLIALPSLRILYMTDEVNDPSLTIKSIGHQWYWTYEYTDYGGLIFNSYMLPPLFLEPGDLRLLDVDNRVVLPIEAPIRMMITSQDVLHSWAVPTLGLKTDAIPGRLNQTTFTATRPGVYYGQCSEICGANHSFMPIVLELIPLKIFEMGPVFTL

SEQ ID NO: 11875 - protein, 261 aa, Artificial Sequence
  Description of Artificial Sequence: Synthetic coding sequence
MTHQSHAYHMVKPSPWPLTGALSALLMTSGLAMWFHFHSMTLLMLGLLTNTLTMYQWWRDVTRESTYQGHHTPPVQKGLRYGMILFITSEVFFFAGFFWAFYHSSLAPTPQLGGHWPPTGITPLNPLEVPLLNTSVLLASGVSITWAHHSLMENNRNQMIQALLITILLGLYFTLLQASEYFESPFTISDGIYGSTFFVATGFHGLHVIIGSTFLTICFIRQLMFHFTSKHHFGFEAAAWYWHFVDVVWLFLYVSIYWWGS

SEQ ID NO: 11876 - protein, 318 aa, Artificial Sequence
  Description of Artificial Sequence: Synthetic coding sequence
MPMANLLLLIVPILIAMAFLMLTERKILGYMQLRKGPNVVGPYGLLQPFADAMKLFTKEPLKPATSTITLYITAPTLALTIALLLWTPLPMPNPLVNLNLGLLFILATSSLAVYSILWSGWASNSNYALIGALRAVAQTISYEVTLAIILLSTLLMSGSFNLSTLITTQEHLWLLLPSWPLAMMWFISTLAETNRTPFDLAEGESELVSGFNIEYAAGPFALFFMAEYTNIIMMNTLTTTIFLGTTYDALSPELYTTYFVTKTLLLTSLFLWIRTAYPRFRYDQLMHLLWKNFLPLTLALLMWYVSMPITISSIPPQT

SEQ ID NO: 11877 - protein, 347 aa, Artificial Sequence
  Description of Artificial Sequence: Synthetic coding sequence
INPLAQPVIYSTIFAGTLITALSSHWFFTWVGLEMNMLAFIPVLTKKMNPRSTEAAIKYFLTQATASMILLMAILFNNMLSGQWTMTNTTNQYSSLMIMMAMAMKLGMAPFHFWVPEVTQGTPLTSGLLLLTWQKLAPISIMYQISPSLNVSLLLTLSILSIMAGSWGGLNQTQLRKILAYSSITHMGWMMAVLPYNPNMTILNLTIYIILTTTAFLLLNLNSSTTTLLLSRTWNKLTWLTPLIPSTLLSLGGLPPLTGFLPKWAIIEEFTKNNSLIIPTIMATITLLNLYFYLRLIYSTSITLLPMSNNVKMKWQFEHTKPTPFLPTLIALTTLLLPISPFMLMIL

SEQ ID NO: 11878 - protein, 115 aa, Artificial Sequence
  Description of Artificial Sequence: Synthetic coding sequence
MNFALILMINTLLALLLMIITFWLPQLNGYMEKSTPYECGFDPMSPARVPFSMKFFLVAITFLLFDLEIALLLPLPWALQTTNLPLMVMSSLLLIIILALSLAYEWLQKGLDWTE

SEQ ID NO: 11879 - protein, 459 aa, Artificial Sequence
  Description of Artificial Sequence: Synthetic coding sequence
MLKLIVPTIMLLPLTWLSKKHMIWINTTTHSLIISIIPLLFFNQINNNLFSCSPTFSSDPLTTPLLMLTTWLLPLTIMASQRHLSSEPLSRKKLYLSMLISLQISLIMTFTATELIMFYIFFETTLIPTLAIITRWGNQPERLNAGTYFLFYTLVGSLPLLIALIYTHNTLGSLNILLLTLTAQELSNSWANNLMWLAYTMAFMVKMPLYGLHLWLPKAHVEAPIAGSMVLAAVLLKLGGYGMMRLTLILNPLTKHMAYPFLVLSLWGMIMTSSICLRQTDLKSLIAYSSISHMALVVTAILIQTPWSFTGAVILMIAHGLTSSLLFCLANSNYERTHSRIMILSQGLQTLLPLMAFWWLLASLANLALPPTINLLGELSVLVTTFSWSNITLLLTGLNMLVTALYSLYMFTTTQWGSLTHHINNMKPSFTRENTLMFMHLSPILLLSLNPDIITGFSS

SEQ ID NO: 11880 - protein, 98 aa, Artificial Sequence
  Description of Artificial Sequence: Synthetic coding sequence
MPLIYMNIMLAFTISLLGMLVYRSHLMSSLLCLEGMMLSLFIMATLMTLNTHSLLANIVPIAMLVFAACEAAVGLALLVSISNTYGLDYVHNLNLLQC

SEQ ID NO: 11881 - protein, 603 aa, Artificial Sequence
  Description of Artificial Sequence: Synthetic coding sequence
MTMHTTMTTLTLTSLIPPILTTLVNPNKKNSYPHYVKSIVASTFIISLFPTTMFMCLDQEVIISNWHWATTQTTQLSLSFKLDYFSMMFIPVALFVTWSIMEFSLWYMNSDPNINQFFKYLLIFLITMLILVTANNLFQLFIGWEGVGIMSFLLISWWYARADANTAAIQAILYNRIGDIGFILALAWFILHSNSWDPQQMALLNANPSLTPLLGLLLAAAGKSAQLGLHPWLPSAMEGPTPVSALLHSSTMVVAGIFLLIRFHPLAENSPLIQTLTLCLGAITTLFAAVCALTQNDIKKIVAFSTSSQLGLMMVTIGINQPHLAFLHICTHAFFKAMLFMCSGSIIHNLNNEQDIRKMGGLLKTMPLTSTSLTIGSLALAGMPFLTGFYSKDHIIETANMSYTNAWALSITLIATSLTSAYSTRMILLTLTGQPRFPTLTNINENNPTLLNPIKRLAAGSLFAGFLITNNISPASPFQTTIPLYLKLTALAVTFLGLLTALDLNYLTNKLKMKSPLCTFYFSNMLGFYPSITHRTIPYLGLLTSQNLPLLLLDLTWLEKLLPKTISQHQISTSIITSTQKGMIKLYFLSFFFPLILTLLLIT

SEQ ID NO: 11882 - protein, 174 aa, Artificial Sequence
  Description of Artificial Sequence: Synthetic coding sequence
MMYALFLLSVGLVMGFVGFSSKPSPIYGGLVLIVSGVVGCVIILNFGGGYMGLMVFLIYLGGMMVVFGYTTAMAIEEYPEAWGSGVEVLVSVLVGLAMEVGLVLWVKEYDGVVVVVNFNSVGSWMIYEGEGSGLIREDPIGAGALYDYGRWLVVVTGWTLFVGVYIVIEIARGN

SEQ ID NO: 11883 - protein, 741 aa, Artificial Sequence
  Description of Artificial Sequence: Synthetic coding sequence
MAEPVSPLKHFVLAKKAITAIFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRHYSVEEREDQIDRLDFIRNQMNLLTLDVKKKIKEVTEEVANKVSCAMTDEICRLSVLVDEFCSEFHPNPDVLKIYKSELNKHIEDGMGRNLADRCTDEVNALVLQTQQEIIENLKPLLPAGIQDKLHTLIPCKKFDLSYNLNYHKLCSDFQEDIVFPFSLGWSSLVHRFLGPRNAQRVLLGLSEPIFQLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRNKAVQLENELENFTKQFLPSSNEES

SEQ ID NO: 11884 - protein, 630 aa, Artificial Sequence
  Description of Artificial Sequence: Synthetic coding sequence
MAEPVSPLKHFVLAKKAITAIFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRHYSVEEREDQIDRLDFIRNQMNLLTLDVKKKIKEVTEEVANKVSCAMTDEICRLSVLVDEFCSEFHPNPDVLKIYKSLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRNKAVQLENELENFTKQFLPSSNEES

SEQ ID NO: 11885 - protein, 155 aa, Artificial Sequence
  Description of Artificial Sequence: Synthetic coding sequence
MAEPVSPLKHFVLAKKAITAIFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAG

SEQ ID NO: 11886 - protein, 741 aa, Artificial Sequence; identical to SEQ ID NO: 11883
  Description of Artificial Sequence: Synthetic coding sequence

SEQ ID NO: 11887 - protein, 447 aa, Artificial Sequence
  Description of Artificial Sequence: Synthetic coding sequence
MAEPVSPLKHFVLAKKAITAIFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRHYSVEEREDQIDRLDFIRNQMNLLTLDVKKKIKEVTEEVANKVSCAMTDEICRLSVLVDEFCSEFHPNPDVLKIYKSKKKK

SEQ ID NO: 11888 - protein, 1336 aa, Artificial Sequence
  Description of Artificial Sequence: Synthetic coding sequence
MMEIQMDEGGGVVVYQDDYCSGSVMSERVSGLAGSIYREFERLIHCYDEEVVKELMPLVVNVLENLDSVLSENQEHEVELELLREDNEQLLTQYEREKALRRQAEEKFIEFEDALEQEKKELQIQVEHYEFQTRQLELKAKNYADQISRLEERESEMKKEYNALHQRHTEMIQTYVEHIERSKMQQVGGNSQTESSLPGRRKERPTSLNVFPLADGTVRAQIGGKLVPAGDHWHLSDLGQLQSSSSYQCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSVRDDFFGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 11889 - protein, 1330 aa, Artificial Sequence
  Description of Artificial Sequence: Synthetic coding sequence
MMEIQMDEGGGVVVYQDDYCSGSVMSERVSGLAGSIYREFERLIHCYDEEVVKELMPLVVNVLENLDSVLSENQEHEVELELLREDNEQLLTQYEREKALRRQAEEKFIEFEDALEQEKKELQIQVEHYEFQTRQLELKAKNYADQISRLEERESEMKKEYNALHQRHTEMIQTYVEHIERSKMQQVGGNSQTESSLPGRRKERPTSLNVFPLADGTVRAQIGGKLVPAGDHWHLSDLGQLQSSSSYQCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 11890 - protein, 522 aa, Artificial Sequence
  Description of Artificial Sequence: Synthetic coding sequence
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 11891 - protein, 486 aa, Artificial Sequence
  Description of Artificial Sequence: Synthetic coding sequence
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 11892 - protein, 132 aa, Artificial Sequence
  Description of Artificial Sequence: Synthetic coding sequence
MAFLDNPTIILAHIRQSHVTSDDTGMCEMVLIDHDVDLEKIHPPSMPGDSGSEIQGSNAQRLERLRKERQNQIKCKNIQWKERNSKQSAQELKSLFEKKSLKEKPPISGKQSILSVRLEQCPLQLNNPFNEY

SEQ ID NO: 11893 - protein, 235 aa, Artificial Sequence
  Description of Artificial Sequence: Synthetic coding sequence
MTVVTMASARVQDLIGLICWQYTSEGREPKLKNAAHGFSLIQVDNTKVTMKEILLKAVKRRKGSQKVSGSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 11894 - protein, 522 aa, Artificial Sequence; identical to SEQ ID NO: 11890
  Description of Artificial Sequence: Synthetic coding sequence

SEQ ID NO: 11895 - protein, 330 aa, Artificial Sequence
  Description of Artificial Sequence: Synthetic coding sequence
MTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 11896 - protein, 225 aa, Artificial Sequence
  Description of Artificial Sequence: Synthetic coding sequence
MPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKHCSSLCRIIMNKCFLQSLALNSSLQRKSLKTLQKSMKPPRNVANSEKGHVGTTATKKIDVYLPLHSSQDRLLPMTVVTMASARVQDLIGLICWQYTSEGREPKL

SEQ ID NO: 11897 - protein, 475 aa, Artificial Sequence
  Description of Artificial Sequence: Synthetic coding sequence
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 11898 - protein, 330 aa, Artificial Sequence; identical to SEQ ID NO: 11895
  Description of Artificial Sequence: Synthetic coding sequence

SEQ ID NO: 11899 - protein, 93 aa, Artificial Sequence
  Description of Artificial Sequence: Synthetic coding sequence
MAFLDNPTIILAHIRQSHVTSDDTGMCEMVLIDHDVDLEKIHPPSMPGDSGSEIQGSNGETQGYVYAQSVDITSSWDFGIRRRSNTAQRLERL

SEQ ID NO: 11900 - protein, 94 aa, Artificial Sequence
  Description of Artificial Sequence: Synthetic coding sequence
  MOD_RES (1)..(1): Any amino acid
XKSFKVSMIHRLRFTTDVQLGHAIFKLTYLSNHDYKHLYFESDAATVNEIVLKVNYILESRASTARADYFAQKQRKLNRRTSFSFQKEKKSGQQ

SEQ ID NO: 11901 - protein, 323 aa, Artificial Sequence
  Description of Artificial Sequence: Synthetic coding sequence
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGACD

SEQ ID NO: 11902 - protein, 335 aa, Artificial Sequence
  Description of Artificial Sequence: Synthetic coding sequence
MKVEFAPLNIQLARRLQTVAVLQWVLKYLLLGPMSIGITVMLIIHNYLFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVMSVGLVSVSKKSVSYMVSKEGGGNISVIVLGGAKESLDAHPGKFTLFIRQRKGFVKIALTHGASLVPVVSFGENELFKQTDNPEGSWIRTVQNKLQKIMGFALPLFHARGVFQYNFGLMTYRKAIHTVVGRPIPVRQTLNPTQEQIEELHQTYMEELRKLFEEHKGKYGIPEHETLVLK

SEQ ID NO: 11903 - protein, 334 aa, Artificial Sequence
  Description of Artificial Sequence: Synthetic coding sequence
MVEFAPLFMPWERRLQTLAVLQFVFSFLALAEICTVGFIALLFTRFWLLTVLYAAWWYLDRDKPRQGGRHIQAIRCWTIWKYMKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGAPLVPIFSFGENDLFDQIPNSSGSWLRYIQNRLQKIMGISLPLFHGRGVFQYSFGLIPYRRPITTVVGKPIEVQKTLHPSEEEVNQLHQRYIKELCNLFEAHKLKFNIPADQHLEFC

SEQ ID NO: 11904 - protein, 252 aa, Artificial Sequence
  Description of Artificial Sequence: Synthetic coding sequence
MKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGAPLVPIFSFGENDLFDQIPNSSGSWLRYIQNRLQKIMGISLPLFHGRGVFQYSFGLIPYRRPITTVVGKPIEVQKTLHPSEEEVNQLHQRYIKELCNLFEAHKLKFNIPADQHLEFC

SEQ ID NO: 11905 - protein, 341 aa, Artificial Sequence
  Description of Artificial Sequence: Synthetic coding sequence
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKLMGFSPCIFWGRGLFSATSWGLLPFAVPITTVVGRPIPVPQRLHPTEEEVNHYHALYMTALEQLFEEHKESCGVPASTCLTFI

SEQ ID NO: 11906 - protein, 281 aa, Artificial Sequence
  Description of Artificial Sequence: Synthetic coding sequence
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGGPPHPRPPAPPPHRGGSQSLSRPLHDGPGAALRGAQGKLWGPRFHLPHLHLGLAAAFR

SEQ ID NO: 11907 - protein, 344 aa, Artificial Sequence
  Description of Artificial Sequence: Synthetic coding sequence
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKLMGFSPCIFWGRGLFSATSWGLLPFAVPITTVGECPPPGGRPPAAAWASGIPRPPVSLSLQWAAPSPSPSASTPPRRKSITITPST

SEQ ID NO: 11908 - protein, 214 aa, Artificial Sequence
  Description of Artificial Sequence: Synthetic coding sequence
MHQQKRQPELVEGNLPVFVFPTELIFYADDQSTHKQVLTLYNPYEFALKFKVLCTTPNKYVVVDAAGAVKPQCCVDIVIRHRDVRSCHYGVIDKFRLQVSEQSQRKALGRKEVVATLLPSAKEQQKEEEEKRLKEHLTESLFFEQSFQPGKNRAVSSGPSLLTVFLGVVCIAALMLPTLGDVESLVPLYLHLSVNQKLVAAYILGLITMAILRT

SEQ ID NO: 11909 - protein, 159 aa, Artificial Sequence
  Description of Artificial Sequence: Synthetic coding sequence
MHQQKRQPELVEGNLPVFVFPTELIFYADDQSTHKQVLTLYNPYEFALKFKVLCTTPNKYVVVDAAGAVKPQCCVDIVIRHRDVRSCHYGVIDKFRLQVSEQSQRKALGRKEVVATLLPSAKEQQKEEEEKRLKEHLTESLFFEQSFQPGLITMAILRT

SEQ ID NO: 11910 - protein, 213 aa, Artificial Sequence
  Description of Artificial Sequence: Synthetic coding sequence
MHQQKRQPELVEGNLPVFVFPTELIFYADDQSTHKQVLTLYNPYEFALKFKVLCTTPNKYVVVDAAGAVKPQCCVDIVIRHRDVRSCHYGVIDKFRLQVSEQSQRKALGRKEVVATLLPSAKEQQKEEEEKRLKEHLTESLFFEQSFQPENRAVSSGPSLLTVFLGVVCIAALMLPTLGDVESLVPLYLHLSVNQKLVAAYILGLITMAILRT

SEQ ID NO: 11911 - protein, 518 aa, Artificial Sequence
  Description of Artificial Sequence: Synthetic coding sequence
MAENHAQNKAKLISETRRRFEAEYVTDKSDKYDARDVERLQQDDNWVESYLSWRHNIVDETLKMLDESFQWRKEISVNDLNESSIPRWLLEIGVIYLHGYDKEGNKLFWIRVKYHVKDQKTILDKKKLIAFWLERYAKRENGKPVTVMFDLSETGINSIDMDFVRFIINCFKVYYPKYLSKIVIFDMPWLMNAAFKIVKTWLGPEAVSLLKFTSKNEVQDYVSVEYLPPHMGGTDPFKYSYPPLVDDDFQTPLCENGPITSEDETSSKEDIESDGKETLETISNEEQTPLLKKINPTESTSKAEENEKVDSKVKAFKKPLSVFKGPLLHISPAEELYFGSTESGEKKTLIVLTNVTKNIVAFKVRTTAPEKYRVKPSNSSCDPGASVDIVVSPHGGLTVSAQDRFLIMAAEMEQSSGTGPAELTQFWKEVPRNKVMEHRLRCHTVESSKPNTLTLKDNAFNMSDKTSEDICLQLSRLLESNRKLEDQVQRCIWFQQLLLSLTMLLLAFVTSFFYLLYS

SEQ ID NO: 11912 - protein, 235 aa, Artificial Sequence
  Description of Artificial Sequence: Synthetic coding sequence
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIVIRHVAPIPSHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGLLTMVFLRT

SEQ ID NO: 11913 - protein, 235 aa, Artificial Sequence; identical to SEQ ID NO: 11912
  Description of Artificial Sequence: Synthetic coding sequence

SEQ ID NO: 11914 - protein, 235 aa, Artificial Sequence; identical to SEQ ID NO: 11912
  Description of Artificial Sequence: Synthetic coding sequence

SEQ ID NO: 11915 - protein, 221 aa, Artificial Sequence
  Description of Artificial Sequence: Synthetic coding sequence
MSDRPEPACAPPPLGPVVPVLVFPPDLVFRADQRSGPRQLLTLYNPTGTALRFRVLCTAPAKYTVFDAEGYVKPQSCIDIVIRHVAPIPSHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGLLTMVFLRT

SEQ ID NO: 11916 - protein, 225 aa, Artificial Sequence
  Description of Artificial Sequence: Synthetic coding sequence
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGLLTMVFLRT

SEQ ID NO: 11917 - protein, 147 aa, Artificial Sequence
  Description of Artificial Sequence: Synthetic coding sequence
MAGWWPALSRAARRHPWPTNVLLYGSLVSAGDALQQRLQGREANWRQTRRVATLVVTFHANFNYVWLRLLERALPGRAPHALLAKLLCDQVVGAPIAVSAFYVEWTDVLALCTADQLQPCSCSMENSLRWSLWFSLGHLHLFFPAEW

SEQ ID NO: 11918 - protein, 196 aa, Artificial Sequence
  Description of Artificial Sequence: Synthetic coding sequence
MAGWWPALSRAARRHPWPTNVLLYGSLVSAGDALQQRLQGREANWRQTRRVATLVVTFHANFNYVWLRLLERALPGRAPHALLAKLLCDQVVGAPIAVSAFYVGMSILQGKDDIFLDLKQKFWNTYLSGLMYWPFVQLTNFSLVPVQWRTAYAGVCGFLWATFICFSQQSGDGTFKSAFTILYTKGTSATEGYPKK

SEQ ID NO: 11919 - protein, 206 aa, Artificial Sequence
  Description of Artificial Sequence: Synthetic coding sequence
MARGGWRRLRRLLSAGQLLFQGRALLVTNTLGCGALMAAGDGVRQSWEIRARPGQVFDPRRSASMFAVGCSMGPFLHYWYLSLDRLFPASGLRGFPNVLKKVLVDQLVASPLLGVWYFLGLGCLEGQTVGESCQELREKFWEFYKADWCVWPAAQFVNFLFVPPQFRVTYINGLTLGWDTYLSYLKYRSPVPLTPPGCVALDTRAD

SEQ ID NO: 11920 - protein, 117 aa, Artificial Sequence
  Description of Artificial Sequence: Synthetic coding sequence
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFVFESCDNSRVSSDIRLS

SEQ ID NO: 11921 - protein, 408 aa, Artificial Sequence
  Description of Artificial Sequence: Synthetic coding sequence
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFERKKTELYQELGLQARDLRFQHVMSITVRNNRIIMRMEYLKAVITPECLLILDYRNLNLEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMV

SEQ ID NO: 11922 - protein, 443 aa, Artificial Sequence
  Description of Artificial Sequence: Synthetic coding sequence
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFERKKTELYQELGLQARDLRFQHVMSITVRNNRIIMRMEYLKAVITPECLLILDYRNLNLEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMMASLPKKTLLADRSMELKNSLRLDGLGSGRSILTNR

SEQ ID NO: 11923 - protein, 446 aa, Artificial Sequence
  Description of Artificial Sequence: Synthetic coding sequence
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFERKKTELYQELGLQARDLRFQHVMSITVRNNRIIMRMEKYSLLLESVASILQNSVSFMERQTEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMMASLPKKTLLADRSMELKNSLRLDGLGSGRSILTNR

SEQ ID NO: 11924 - protein, 182 aa, Artificial Sequence
  Description of Artificial Sequence: Synthetic coding sequence
  MOD_RES (1)..(1): Any amino acid
XRAAQLCGPDRLRVAGEVHRFRTSDVSQATLASVAPVFTVTKFDKQGNVTSFERKKTELYQELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNL

SEQ ID NO: 11925 - protein, 393 aa, Artificial Sequence
  Description of Artificial Sequence: Synthetic coding sequence
MECLRSLPCLLPRAMRLPRRTLCALALDVTSVGPPVAACGRRANLIGRSRAAQLCGPDRLRVAGEVHRFRTSDVSQATLASVAPVFTVYLKAVITPECLLILDYRNLNLEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMMASLPKKTLLADRSMELKNSLRLDGLGSGRSILTNR

SEQ ID NO: 11926 - protein, 152 aa, Artificial Sequence
  Description of Artificial Sequence: Synthetic coding sequence
MELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMMASLPKKTLLADRSMELKNSLRLDGLGSGRSILTNR

SEQ ID NO: 11927 - protein, 417 aa, Artificial Sequence
  Description of Artificial Sequence: Synthetic coding sequence
MALSAQQIPRWFNSVKLRSLINAAQLTKRFTRPARTLLHGFSAQPQISSDNCFLQWGFKTYRTSSLWNSSQSTSSSSQENNSAQSSLLPSMNEQSQKTQNISSFDSELFLEELDELPPLSPMQPISEEEAIQIIADPPLPPASFTLRDYVDHSETLQKLVLLGVDLSKIEKHPEAANLLLRLDFEKDIKQMLLFLKDVGIEDNQLGAFLTKNHAIFSEDLENLKTRVAYLHSKNFSKADVAQMVRKAPFLLNFSVERLDNRLGFFQKELELSVKKTRDLVVRLPRLLTGSLEPVKENMKVYRLELGFKHNEIQHMITRIPKMLTANKMKLTETFDFVHNVMSIPHHIIVKFPQVFNTRLFKVKERHLFLTYLGRAQYDPAKPNYISLDKLVSIPDEIFCEEIAKASVQDFEKFLKTL

SEQ ID NO: 11928 - protein, 385 aa, Artificial Sequence
  Description of Artificial Sequence: Synthetic coding sequence
MLWKLLLRSQSCRLCSFRKMRSPPKYRPFLACFTYTTDKQSSKENTRTVEKLYKCSVDIRKIRRLKGWVLLEDETYVEEIANILQELGADETAVASILERCPEAIVCSPTAVNTQRKLWQLVCKNEEELIKLIEQFPESFFTIKDQENQKLNVQFFQELGLKNVVISRLLTAAPNVFHNPVEKNKQMVRILQESYLDVGGSEANMKVWLLKLLSQNPFILLNSPTAIKETLEFLQEQGFTSFEILQLLSKLKGFLFQLCPRSIQNSISFSKNAFKCTDHDLKQLVLKCPALLYYSVPVLEERMQGLLREGISIAQIRETPMVLELTPQIVQYRIRKLNSSGYRIKDGHLANLNGSKKEFEANFGKIQAKKVRPLFNPVAPLNVEE

SEQ ID NO: 11929 - protein, 385 aa, Artificial Sequence; identical to SEQ ID NO: 11928
  Description of Artificial Sequence: Synthetic coding sequence

SEQ ID NO: 11930 - protein, 178 aa, Artificial Sequence
  Description of Artificial Sequence: Synthetic coding sequence
MLWKLLLRSQSCRLCSFRKMRSPPKYRPFLACFTYTTDKQSSKENTRTVEKLYKCSVDIRKIRRLKGWVLLEDETYVEEIANILQELGADETAVASILERCPEAIVCSPTAVNTQRKLWQLVCKNEEELIKLIEQFPESFFTIKDQENQKLNVQFFQELGLKNVVISRLLTAAPNVFH

SEQ ID NO: 11931 - protein, 33 aa, Artificial Sequence
  Description of Artificial Sequence: Synthetic coding sequence
MLWKLLLRSQSCRLCSFRKMRSPPKYRPFLACF

SEQ ID NO: 11932 - protein, 86 aa, Artificial Sequence
  Description of Artificial Sequence: Synthetic coding sequence
MLWKLLLRSQSCRLCSFRKMRSPPKYRPFLACFTYTTDKQSSKENTRTVEKLYKCSVDIRKIRRLKGWVLLEDETYVEEIANILQE

SEQ ID NO: 11933 - protein, 385 aa, Artificial Sequence; identical to SEQ ID NO: 11928
  Description of Artificial Sequence: Synthetic coding sequence

SEQ ID NO: 11934 - protein, 566 aa, Artificial Sequence
  Description of Artificial Sequence: Synthetic coding sequence
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 11935 - protein, 416 aa, Artificial Sequence
  Description of Artificial Sequence: Synthetic coding sequence
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 11936 - protein, 382 aa, Artificial Sequence
  Description of Artificial Sequence: Synthetic coding sequence
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPVLHSPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 11937 - protein, 295 aa, Artificial Sequence
  Description of Artificial Sequence: Synthetic coding sequence
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPASKPAGDQLPAALWTSSAVLGLLLLALPTYHLWKRCRHLAEDDTHPPASLRLLPQVSAWAGLRGTGQVGISPS

SEQ ID NO: 11938 - protein, 200 aa, Artificial Sequence
  Description of Artificial Sequence: Synthetic coding sequence
MDFGLALLLAGLLGLLLAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPASKPAGDQLPAALWTSSAVLGLLLLALPTYHLWKRCRHLAEDDTHPPASLRLLPQVSAWAGLRGTGQVGISPS

SEQ ID NO: 11939 - protein, 406 aa, Artificial Sequence
  Description of Artificial Sequence: Synthetic coding sequence
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPALHALSNPEAPAAESPQAPSLSTPASSHPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 11940 - protein, 398 aa, Artificial Sequence
  Description of Artificial Sequence: Synthetic coding sequence
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPALHGWLSPPPPQNTGPHGPHPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 11941 - protein, 390 aa, Artificial Sequence
  Description of Artificial Sequence: Synthetic coding sequence
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPALHALSNPEAPAPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 11942 - protein, 306 aa, Artificial Sequence
  Description of Artificial Sequence: Synthetic coding sequence
MGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAHRKEEPPLSMKCTLFSGDIGPSL

SEQ ID NO: 11943 - protein, 778 aa, Artificial Sequence
  Description of Artificial Sequence: Synthetic coding sequence
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 11944 - protein, 245 aa, Artificial Sequence
  Description of Artificial Sequence: Synthetic coding sequence
MYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKFQTQSLRLSDLHRKSHLWRGIVSITLIEGRDLKAMDSNGLSDPYVKFRLGHQKYKSKIMPKTLNPQWREQFDFHLYEERCGISPGESHQSGRVNGCRRHW

SEQ ID NO: 11945 - protein, 692 aa, Artificial Sequence
  Description of Artificial Sequence: Synthetic coding sequence
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 11946 - protein, 515 aa, Artificial Sequence
  Description of Artificial Sequence: Synthetic coding sequence
MDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 11947 - protein, 600 aa, Artificial Sequence
  Description of Artificial Sequence: Synthetic coding sequence
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVALYGTFINV

SEQ ID NO: 11948 - protein, 81 aa, Artificial Sequence
  Description of Artificial Sequence: Synthetic coding sequence
MLDSCKLKSACNLPFICNKKIINTAGTSNAEVPLADPGMYQLDITLRRGQSLAARDRGGTSDPYVKFKIGGKEVFRSKIIH

SEQ ID NO: 11949 - protein, 999 aa, Artificial Sequence
  Description of Artificial Sequence: Synthetic coding sequence
MEPRAAAAGEPEPPAASSSFQARLWKNLQLGVGRSKGGGGGRAGGPERRTADTPSPSPPPPVGTGNAPARGSGAGSRWSGFKKRKQVLDRVFSSSQPNLCCSSPEPLEPGGAGRAEQGSTLRRRIREHLLPAVKGPAAASGAAGGTPPGGRSPDSAPSSSSASSSLSSSPQPPPRGDRARDEGARRQGPGAHLCHQKSSSLPGTACLEQLLEPPPPPAEPARSPAESRAPETGEEHGSSQKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 11950 - protein, 306 aa, Artificial Sequence; identical to SEQ ID NO: 11942
  Description of Artificial Sequence: Synthetic coding sequence

SEQ ID NO: 11951 - protein, 878 aa, Artificial Sequence
  Description of Artificial Sequence: Synthetic coding sequence
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSVPGEASDGLSNLPSPFAYLLTIHLKEGRNLVVRDRCGTSDPYVKFKLNGKTLYKSKVIYKNLNPVWDEIVVLPIQSLDQKLRVKVYDRDLTTSDFMGSAFVILSDLELNRTTEHILKLEDPNSLEDDMGVIVLNLNLVVKQGDFKRHRWSNRKRLSASKSSLIRNLRLSESLKKNQLWNGIISITLLEGKNVSGGSMTEMFVQLKLGDQRYKSKTLCKSANPQWQEQFDFHYFSDRMGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAVFLITVWNFELYMIPLALLLIFVYNFIRPVKGKVSSIQDSQESTDIDDEEDEDDKESEKKGLIERIYMVQDIVSTVQNVLEEIASFGERIKNTFNWTVPFLSSLACLILAAATIILYFIPLRYIILIWGINKFTKKLRNPYSIDNNELLDFLSRVPSDVQKVQYAELKLCSSHSPLRKKRSAL

SEQ ID NO: 11952 - protein, 823 aa, Artificial Sequence
  Description of Artificial Sequence: Synthetic coding sequence
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSVPGEASDGLSNLPSPFAYLLTIHLKEGRNLVVRDRCGTSDPYVKFKLNGKTLYKSKVIYKNLNPVWDEIVVLPIQSLDQKLRVKVYDRDLTTSDFMGSAFVILSDLELNRTTEHILKLEDPNSLEDDMGVIVLNLNLVVKQGDFKRHRWSNRKRLSASKSSLIRNLRLSESLKKNQLWNGIISITLLEGKNVSGGSMTEMFVQLKLGDQRYKSKTLCKSANPQWQEQFDFHYFSDRMGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAESEKKGLIERIYMVQDIVSTVQNVLEEIASFGERIKNTFNWTVPFLSSLACLILAAATIILYFIPLRYIILIWGINKFTKKLRNPYSIDNNELLDFLSRVPSDVQKVQYAELKLCSSHSPLRKKRSAL

SEQ ID NO: 11953 - protein, 396 aa, Artificial Sequence
  Description of Artificial Sequence: Synthetic coding sequence
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSVPGEASDGLSNLPSPFAYLLTIHLKEGRNLVVRDRCGTSDPYVKFKLNGKTLYKSKVIYKNLNPVWDEIVVLPIQSLDQKLRVKVYDRDLTTSDFMGSAFVILSDLELNRTTEHILKLEDPNSLEDDMGVIVLNLNLVVKQGDFKRHRWSNRKRLSASKSSLIRNLRLSESLKKNQLWNGIISITLLEGKNVSGGSMTEMFVQLKLGDQRYKSKDGHFGH

SEQ ID NO: 11954 - protein, 886 aa, Artificial Sequence
  Description of Artificial Sequence: Synthetic coding sequence
MGMDLTCPFGISPACGAQASWSIFGADAAEVPGTRGHSQQEAAMPHIPEDEEPPGEPQAAQSPAGQQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPEGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 11955 - protein, 903 aa, Artificial Sequence
  Description of Artificial Sequence: Synthetic coding sequence
MGMDLTCPFGISPACGAQASWSIFGADAAEVPGTRGHSQQEAAMPHIPEDEEPPGEPQAAQSPAGQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 11956 - protein, 597 aa, Artificial Sequence
  Description of Artificial Sequence: Synthetic coding sequence
MALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 11957 - protein, 885 aa, Artificial Sequence
  Description of Artificial Sequence: Synthetic coding sequence
MGMDLTCPFGISPACGAQASWSIFGADAAEVPGTRGHSQQEAAMPHIPEDEEPPGEPQAAQSPAGQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPDGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 11958 - protein, 821 aa, Artificial Sequence
  Description of Artificial Sequence: Synthetic coding sequence
LTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 11959 - protein, 597 aa, Artificial Sequence; identical to SEQ ID NO: 11956
  Description of Artificial Sequence: Synthetic coding sequence

SEQ ID NO: 11960 - protein, 821 aa, Artificial Sequence; identical to SEQ ID NO: 11958
  Description of Artificial Sequence: Synthetic coding sequence

SEQ ID NO: 11961 - protein, 821 aa, Artificial Sequence
  Description of Artificial Sequence: Synthetic coding sequence
MTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 11962 - protein, 597 aa, Artificial Sequence; identical to SEQ ID NO: 11956
  Description of Artificial Sequence: Synthetic coding sequence

SEQ ID NO: 11963 - protein, 912 aa, Artificial Sequence
  Description of Artificial Sequence: Synthetic coding sequence
MVKAPQSEERLARGGKENNSVLACGAQASWSIFGADAAEVPGTRGHSQQEAAMPHIPEDEEPPGEPQAAQSPAGQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 11964 - protein, 904 aa, Artificial Sequence
  Description of Artificial Sequence: Synthetic coding sequence
MGMDLTCPFGISPACGAQASWSIFGADAAEVPGTRGHSQQEAAMPHIPEDEEPPGEPQAAQSPAGQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 11965 - protein, 706 aa, Artificial Sequence
  Description of Artificial Sequence: Synthetic coding sequence
MVKAPQSEERLARGGKENNSVLACGAQASWSIFGADAAEVPGTRGHSQQEAAMPHIPEDEEPPGEPQAAQSPAGQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 11966 - protein, 576 aa, Artificial Sequence
  Description of Artificial Sequence: Synthetic coding sequence
MADANKAEVPGATGGDSPHLQPAEPPGEPRREPHPAEAEKQQPQHSSSSNGVKMENDESAKEEKSDLKEKSTGSKKANRFHPYSKDKNSGAGEKKGPNRNRVFISNIPYDMKWQAIKDLMREKVGEVTYVELFKDAEGKSRGCGVVEFKDEEFVKKALETMNKYDLSGRPLNIKEDPDGENARRALQRTGGSFPGGHVPDMGSGLMNLPPSILNNPNIPPEVISNLQAGRLGSTIFVANLDFKVGWKKLKEVFSIAGTVKRADIKEDKDGKSRGMGTVTFEQAIEAVQAISMFNGQFLFDRPMHVKMDDKSVPHEEYRSHDGKTPQLPRGLGGIGMGLGPGGQPISASQLNIGGVMGNLGPGGMGMDGPGFGGMNRIGGGIGFGGLEAMNSMGGFGGVGRMGELYRGAMTSSMERDFGRGDIGINQGFGDSFGRLGGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 11967 - protein, 600 aa, Artificial Sequence
  Description of Artificial Sequence: Synthetic coding sequence
MADANKAEVPGATGGDSPHLQPAEPPGEPRREPHPAEAEKQQPQHSSSSNGVKMENDESAKEEKSDLKEKSTGSKKANRFHPYSKDKNSGAGEKKGPNRNRVFISNIPYDMKWQAIKDLMREKVGEVTYVELFKDAEGKSRGCGVVEFKDEEFVKKALETMNKYDLSGRPLNIKEDPDGENARRALQRTGGSFPGGHVPDMGSGLMNLPPSILNNPNIPPEVISNLQAGRLGSTIFVANLDFKVGWKKLKEVFSIAGTVKRADIKEDKDGKSRGMGTVTFEQAIEAVQAISMFNGQFLFDRPMHVKMDDKSVPHEEYRSHDGKTPQLPRGLGGIGMGLGPGGQPISASQLNIGGVMGNLGPGGMGMDGPGFGGMNRIGGGIGFGGLEAMNSMGGFGGVGRMGELYRGAMTSSMERDFGRGDIGINQGFGDSFGRLGSAMIGGFAGRIGSSNMGPVGSGISGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 11968 - protein, 188 aa, Artificial Sequence
  Description of Artificial Sequence: Synthetic coding sequence
MNSMGGFGGVGRMGELYRGAMTSSMERDFGRGDIGINQGFGDSFGRLGGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 11969 - protein, 126 aa, Artificial Sequence
  Description of Artificial Sequence: Synthetic coding sequence
  MOD_RES (1)..(1): Any amino acid
XGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 11970 - protein, 269 aa, Artificial Sequence
  Description of Artificial Sequence: Synthetic coding sequence
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 11971 - protein, 209 aa, Artificial Sequence
  Description of Artificial Sequence: Synthetic coding sequence
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGAQSYMHS

SEQ ID NO: 11972 - protein, 119 aa, Artificial Sequence
  Description of Artificial Sequence: Synthetic coding sequence
MAASAGAGAVIAAPDSRRWLWSVLAAALGLLTAGVSALEVYTPKEIFVANGTQGKLTCKFKSTSTTGGLTSVSWSFQPEGADTTVSGPVIYAQLDHSGGHHSDKINKSESVVYADIRKN

SEQ ID NO: 11973 - protein, 2048 aa, Artificial Sequence
  Description of Artificial Sequence: Synthetic coding sequence
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 11974 - protein, 2061 aa, Artificial Sequence
  Description of Artificial Sequence: Synthetic coding sequence
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 11975 - protein, 160 aa, Artificial Sequence
  Description of Artificial Sequence: Synthetic coding sequence
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGKLTLLKAQPPPGGGC

SEQ ID NO: 11976 - protein, 445 aa, Artificial Sequence
  Description of Artificial Sequence: Synthetic coding sequence
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDW

SEQ ID NO: 11977 - protein, 2061 aa, Artificial Sequence
  Description of Artificial Sequence: Synthetic coding sequence
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLVSIEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 11978 - protein, 2051 aa, Artificial Sequence
  Description of Artificial Sequence: Synthetic coding sequence
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKCLSSMSTALSKMASPATVHVLDEEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQRYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 11979 - protein, 285 aa, Artificial Sequence
  Description of Artificial Sequence: Synthetic coding sequence
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWVREFNKFDLYTKCPDLPDVDKLRPYYQGLIDKYCPGILSW

SEQ ID NO: 11980 - protein, 270 aa, Artificial Sequence
  Description of Artificial Sequence: Synthetic coding sequence
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWQVRPLHQVPGPAGRGQAAALLPGAH

SEQ ID NO: 11981 - protein, 231 aa, Artificial Sequence
  Description of Artificial Sequence: Synthetic coding sequence
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKVPNLPCPSPSQTGSTSSGSCTTWGRSWPCSGSPSGLSSATPSPSDAVRRPPWFSATPPSRTTLTSRILDTAQSSGCISPTVGSTGSSCPGAMMQVRPLHQVPGPAGRGQAAALLPGAH

SEQ ID NO: 11982 - protein, 265 aa, Artificial Sequence
  Description of Artificial Sequence: Synthetic coding sequence
GPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWVREFNKFDLYTKCPDLPDVDKLRPYYQGLIDKYCPGILSW

SEQ ID NO: 11983 - protein, 940 aa, Artificial Sequence
  Description of Artificial Sequence: Synthetic coding sequence
MEIDQCLLESLPLGQRQRLVKRMRCEQIKAYYEREKAFQKQEGFLKRLKHAKNPKVHFNLTDMLQDAIIHHNDKEVLRLLKEGADPHTLVSSGGSLLHLCARYDNAFIAEILIDRGVNVNHQDEDFWTPMHIACACDNPDIVLLLVLAGANVLLQDVNGNIPLDYAVEGTESSSILLTYLDENGVDLTSLRQMKLQRPMSMLTDVKHFLSSGGNVNEKNDEGVTLLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKRGRCF

SEQ ID NO: 11984 - protein, 1858 aa, Artificial Sequence
  Description of Artificial Sequence: Synthetic coding sequence
MEIDQCLLESLPLGQRQRLVKRMRCEQIKAYYEREKAFQKQEGFLKRLKHAKNPKVHFNLTDMLQDAIIHHNDKEVLRLLKEGADPHTLVSSGGSLLHLCARYDNAFIAEILIDRGVNVNHQDEDFWTPMHIACACDNPDIVLLLVLAGANVLLQDVNGNIPLDYAVEGTESSSILLTYLDENGVDLTSLRQMKLQRPMSMLTDVKHFLSSGGNVNEKNDEGVTLLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSRYKPLADTFLREKKEQSAAERCRLVLQQCKLQGWQMGVRKVFLKYWHADQLNDLCLQLQRKIITCQKVIRGFLARQHLLQRISIRQQEVTSINSFLQNTEDMGLKTYDALVIQNASDIARENDRLRSEMNAPYHKEKLEVRNMQEEGSKRTDDKSGPRHFHPSSMSVCAAVDGLGQCLVGPSIWSPSLHSVFSMDDSSSLPSPRKQPPPKPKRDPNTRLSASYEAVSACLSAAREAANEALARPRPHSDDYSTMKKIPPRKPKRSPNTKLSGSYEEISGSRPGDARPAGAPGAAARVLTPGTPQCALPPAAPPGDEDDSEPVYIEMLGHAARPDSPDPGESVYEEMKCCLPDDGGPGAGSFLLHGASPPLLHRAPEDEAAGPPGDACDIPPPFPNLLPHRPPLLVFPPTPVTCSPASDESPLTPLEVKKLPVLETNLKYPVQPEGSSPLSPQYSKSQKGDGDRPASPGLALFNGSGRASPPSTPPPPPPPPGPPPAPYRPCAHLAFPPEPAPVNAGKAGPSAEAPKVHPKPNSAPVAGPCSSFPKIPYSPVKATRADARKAGSSASPPAPYSPPSSRPLSSPLDELASLFNSGRSVLRKSAAGRKIREAEGFETNMNISSRDDPSTSEITSETQDRNANNHGIQLSNSLSSAITAENGNSISNGLPEEDGYSRLSISGTGTSTFQRHRDSHTTQVIHQLRLSENESVALQELLDWRRKLCEEGQDWQQILHHAEPRVPPPPPCKKPSLLKKPEGASCNRLPSELWDTTI

SEQ ID NO: 11985 - protein, 1858 aa, Artificial Sequence; identical to SEQ ID NO: 11984
  Description of Artificial Sequence: Synthetic coding sequence

SEQ ID NO: 11986 - protein, 878 aa, Artificial Sequence
  Description of Artificial Sequence: Synthetic coding sequence
MKLQRPMSMLTDVLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSR

SEQ ID NO: 11987 - protein, 940 aa, Artificial Sequence
  Description of Artificial Sequence: Synthetic coding sequence
MEIDQCLLESLPLGQRQRLVKRMRCEQIKAYYEREKAFQKQEGFLKRLKHAKNPKVHFNLTDMLQDAIIHHNDKEVLRLLKEGADPHTLVSSGGSLLHLCARYDNAFIAEILIDRGVNVNHQDEDFWTPMHIACACDNPDIVLLLVLAGANVLLQDVNGNIPLDYAVEGTESSSILLTYLDENGVDLTSLRQMKLQRPMSMLTDVKHFLSSGGNVNEKNDEGVTLLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKNRRCF

SEQ ID NO: 11988 - protein, 857 aa, Artificial Sequence
  Description of Artificial Sequence: Synthetic coding sequence
MRRADTRDGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSRYKPLADTFLREKKEQSAAERCRLVLQQCKLQGWQMGVRKVFLKYWHADQLNDLCLQLQRKIITCQKVIRGFLARQHLLQRISIRQQEVTSINSFLQNTEDMGLKTYDALVIQNASDIARENDRLRSEMNAPYHKEKLEVRNMQEEGSKRTDDKSGPRHFHPSSMSVCAAVDGLGQCLVGPSIWSPSLHSVFSMDDSSSLPSPRKQPPPKPKRDPNTRLSASYEAVSACLSAAREAANEGQPWGGTQPRVPGSRML

SEQ ID NO: 11989 - protein, 226 aa, Artificial Sequence
  Description of Artificial Sequence: Synthetic coding sequence
MLLRLVSNSWPQVILPPRPPKVLGLQAPRRARKRAEGTASSNVFSMFDQSQIQEFKESLALSPRLERNGMISAHCNLCLTGSSNSPASASQAFTIMDQNRDGFIDKEDLRDTFAALGRINVKNEELEAMVKEAPGPINFTVFLTMFGEKLKGTDPEETILHAFKVFDTEGKGFVKADVIKEKLMTQADRFSEEEVKQMFAAFPPDVCGNLDYRNLCYVITHGEEKD

SEQ ID NO: 11990 - protein, 332 aa, Artificial Sequence
  Description of Artificial Sequence: Synthetic coding sequence
MGAQFSKTAAKGEAAAERPGEAAVASSPSKANGQENGHVKVNGDASPAAAESGAKEELQANGSAPAADKEEPAAAGSGAASPSAAEKGEPAAAAAPEAGASPVEKEAPAEGEAAEPGSPTAAEGEAASAASSTSSPKAEDGATPSPSNETPKKKKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 11991 - protein, 325 aa, Artificial Sequence
  Description of Artificial Sequence: Synthetic coding sequence
MAEVPPGPSSLLPPPAPPAPAAVEPRCPFPAGAALACCSEDEEQQQLNGLISPELRHLRAAASLKSKVLSVAEVAATTATPDGGPRATATKGAGVHSGERPPHSLSSNARTAVPSPVEAAAASDPAAARNGLAEGTEQEEEEEDEQVRLLSSSLTADCSLRSPSGREVEPGEDRTIRYVRYESELQMPDIMRLITKDLSEPYSIYTYRYFIHNWPQLCFLAMVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 11992 - protein, 362 aa, Artificial Sequence
  Description of Artificial Sequence: Synthetic coding sequence
MAEVPPGPSSLLPPPAPPAPAAVEPRCPFPAGAALACCSEDEEDDEEHEGGGSRSPAGGESATVAAKGHPCLRCPQPPQEQQQLNGLISPELRHLRAAASLKSKVLSVAEVAATTATPDGGPRATATKGAGVHSGERPPHSLSSNARTAVPSPVEAAAASDPAAARNGLAEGTEQEEEEEDEQVRLLSSSLTADCSLRSPSGREVEPGEDRTIRYVRYESELQMPDIMRLITKDLSEPYSIYTYRYFIHNWPQLCFLAMVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 11993 - protein, 725 aa, Artificial Sequence
  Description of Artificial Sequence: Synthetic coding sequence
MVMKASVDDDDSGWELSMPEKMEKSNTNWVDITQDFEEACRELKLGELLHDKLFGLFEAMSAIEMMDPKMDAGMIGNQVNRKVLNFEQAIKDGTIKIKDLTLPELIGIMDTCFCCLITWLEGHSLAQTVFTCLYIHNPDFIEDPAMKAFALGILKICDIAREKVNKAAVFEEEDFQSMTYGFKMANSVTDLRVTGMLKDVEDDMQRRVKSTRSRQGEERDPEVELEHQQCLAVFSRVKFTRVLLTVLIAFTKKETSAVAEAQKLMVQAADLLSAIHNSLHHGIQAQNDTTKGDHPIMMGFEPLVNQRLLPPTFPRYAKIIKREEMVNYFARLIDRIKTVCEVVNLTNLHCILDFFCEFSEQSPCVLSRSLLQTTFLVDNKKVFGTHLMQDMVKDALRSFVSPPVLSPKCYLYNNHQAKDCIDSFVTHCVRPFCSLIQIHGHNRARQRDKLGHILEEFATLQDEAEKVDAALHTMLLKQEPQRQHLACLGTWVLYHNLRIMIQYLLSGFELELYSMHEYYYIYWYLSEFLYAWLMSTLSRADGSQMAEERIMEEQQKGRSSKKTKKKKKVRPLSREITMSQAYQNMCAGMFKTMVAFDMDGKVRKPKFELDSEQVRYEHRFAPFNSVMTPPPVHYLQFKEMSDLNKYSPPPQSPELYVAASKHFQQAKMILENIPNPDHEVNRILKVAKPNFVVMKLLAGGHKKESKVPPEFDFSAHKYFPVVKLV

SEQ ID NO: 11994 - protein, 294 aa, Artificial Sequence
  Description of Artificial Sequence: Synthetic coding sequence
MVMKASVDDDDSGWELSMPEKMEKSNTNWVDITQDFEEACRELKLGELLHDKLFGLFEAMSAIEMMDPKMDAGMIGNQVNRKVLNFEQAIKDGTIKIKDLTLPELIGIMDTCFCCLITWLEGHSLAQTVFTCLYIHNPDFIEDPAMKAFALGILKICDIAREKVNKAAVFEEEDFQSMTYGFKMANSVTDLRVTGMLKDVEDDMQRRVKSTRSRQGEERDPEVELEHQQCLAVFSRVKFTRVLLTVLIAFTKKETSAVAEAQKLMVQAADLLSAIHNSLHHGIQAQNDTTKGGL

SEQ ID NO: 11995 - protein, 197 aa, Artificial Sequence
  Description of Artificial Sequence: Synthetic coding sequence
MVMKASVDDDDSGWELSMPEKMEKSNTNWVDITQDFEEACRELKLGELLHDKLFGLFEAMSAIEMMDPKMDAGMIGNQVNRKVLNFEQAIKDGTIKIKDLTLPELIGIMDTCFCCLITWLEGHSLAQTVFTCLYIHNPDFIEDPAMKAFALGILKICDIAREKVNKAAVFEEISRLLELIDFHEYNFKNENVQCWKE

SEQ ID NO: 11996 - protein, 206 aa, Artificial Sequence
  Description of Artificial Sequence: Synthetic coding sequence
MAPSHLSVREMREDEKPLVLEMLKAGVKDTENRVALHALTRPPALLLLAAASSGLRFVLASFALALLLPVFLAVAAVKLGLRARWGSLPPPGGLGGPWVAVRGSGDVCGVLALAPGTNAGDGARVTRLSVSRWHRRRGVGRRLLAFAEARARAWAGGMGEPRARLVVPVAVAAWGVGGMLEGCGYQAEGGWGCLGYTLVREFSKDL

SEQ ID NO: 11997 - protein, 726 aa, Artificial Sequence
  Description of Artificial Sequence: Synthetic coding sequence
MSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKSKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 11998 - protein, 240 aa, Artificial Sequence [sequence omitted]

SEQ ID NO: 11999 - protein, 780 aa, Artificial Sequence
  Description of Artificial Sequence: Synthetic coding sequence
MAKRTFSNLETFLIFLLVMMSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 12000 - protein, 622 aa, Artificial Sequence
  Description of Artificial Sequence: Synthetic coding sequence
MDSEKSSEWRSDVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 12001 - protein, 745 aa, Artificial Sequence
  Description of Artificial Sequence: Synthetic coding sequence
MAKRTFSNLETFLIFLLVMMSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKSKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 12002 - protein, 279 aa, Artificial Sequence
  Description of Artificial Sequence: Synthetic coding sequence
MLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRASYYEISVDDGPWEKQKSSGLNLCTGTGSKAWSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 12003 - protein, 442 aa, Artificial Sequence
  Description of Artificial Sequence: Synthetic coding sequence
MTCYRGFLLGSCCRVAGGRAAALRGPGAGGPAARPRLGGDGGGRRHLGQGQPRELAGCGSRADGGFRPSRVVVVAKTTRYEFEQQRYRYAELSEEDLKQLLALKGSSYSGLLERHHIHTKNVEHIIDSLRNEGIEVRLVKRREYDEETVRWADAVIAAGGDGTMLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRASYYEISVDDGPWEKQKSSGLNLCTGTGSKAWSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 12004 - protein, 279 aa, Artificial Sequence; identical to SEQ ID NO: 12002
  Description of Artificial Sequence: Synthetic coding sequence

SEQ ID NO: 12005 - protein, 301 aa, Artificial Sequence
  Description of Artificial Sequence: Synthetic coding sequence
MLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRMSYSWAVAVDNLRRSIPTLKGLASYYEISVDDGPWEKQKSSGLNLCTGTGSKAWSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 12006 - protein, 410 aa, Artificial Sequence
  Description of Artificial Sequence: Synthetic coding sequence
MTCYRGFLLGSCCRVAGGRAAALRGPGAGGPAARPRLGGDGGGRRHLGQGQPRELAGCGSRADGGFRPSRVVVVAKTTRYEFEQQRYRYAELSEEDLKQLLALKGSSYSGLLERHHIHTKNVEHIIDSLRNEGIEVRLVKRREYDEETVRWADAVIAAGGDGTMLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 12007 - protein, 63 aa, Artificial Sequence
  Description of Artificial Sequence: Synthetic coding sequence
MELVQVLKRGLQQITGHGGLRGYLRVFFRTNDAKVGTLVGEDKYGNKYYEDNKQFFGIVGFTV

SEQ ID NO: 12008 - protein, 145 aa, Artificial Sequence
  Description of Artificial Sequence: Synthetic coding sequence
MELVQVLKRGLQQITGHGGLRGYLRVFFRTNDAKVGTLVGEDKYGNKYYEDNKQFFGRHRWVVYTTEMNGKNTFWDVDGSMVPPEWHRWLHSMTDDPPTTKPLTARKFIWTNHKFNVTGTPEQYVPYSTTRKKIQEWIPPSTPYK

SEQ ID NO: 12009 - protein, 84 aa, Artificial Sequence
  Description of Artificial Sequence: Synthetic coding sequence
MAARVGAFLKNAWDKEPVLVVSFVVGGLAVILPPLSPYFKYSVMINKATPYNYPVPVRDDGNMPDVPSHPQDPQGPSLEWLKKL

SEQ ID NO: 12010 - protein, 84 aa, Artificial Sequence; identical to SEQ ID NO: 12009
  Description of Artificial Sequence: Synthetic coding sequence

SEQ ID NO: 12011 - protein, 84 aa, Artificial Sequence; identical to SEQ ID NO: 12009
  Description of Artificial Sequence: Synthetic coding sequence

SEQ ID NO: 12012 - protein, 81 aa, Artificial Sequence
  Description of Artificial Sequence: Synthetic coding sequence
MLRQIIGQAKKHPSLIPLFVFIGTGATGATLYLLRLALFNPDVCWDRNNPEPWNKLGPNDQYKFYSVNVDYSKLKKERPDF

SEQ ID NO: 12013 - protein, 56 aa, Artificial Sequence
  Description of Artificial Sequence: Synthetic coding sequence
IPVAIFITLVNVFIGQAELAEIPEGYVPEHWEYYKGKGAGSAKIDACERRWTLVLL

SEQ ID NO: 12014 - protein, 105 aa, Artificial Sequence
  Description of Artificial Sequence: Synthetic coding sequence
MICWRHPSAPCGRGEWQVPRSQLPLARVEFPVALGLGVAVGAEAAAIMVNLLQIVRDHWVHVLVPMGFVIGCYLDRKSDERLTAFRNKSMLFKRELQPSEEVTWK

SEQ ID NO: 12015 - protein, 58 aa, Artificial Sequence
  Description of Artificial Sequence: Synthetic coding sequence
MVNLLQIVRDHWVHVLVPMGFVIGCYLDRKSDERLTAFRNKSMLFKRELQPSEEVTWK

SEQ ID NO: 12016 - protein, 58 aa, Artificial Sequence; identical to SEQ ID NO: 12015
  Description of Artificial Sequence: Synthetic coding sequence

SEQ ID NO: 12017 - protein, 95 aa, Artificial Sequence
  Description of Artificial Sequence: Synthetic coding sequence
MESHERQPLVLHEEMGECRSSLSAGGGVHIEPRYRQFPQLTRSQVFQSEFFSGLMWFWILWRFWHDSEEVLGHFPYPDPSQWTDEELGIPPDDED

SEQ ID NO: 12018 - protein, 105 aa, Artificial Sequence
  Description of Artificial Sequence: Synthetic coding sequence
MSALTRLASFARVGGRLFRSGCARTAGDGGVRHAGGGVHIEPRYRQFPQLTRSQVFQSEFFSGLMWFWILWRFWHDSEEVLGHFPYPDPSQWTDEELGIPPDDED

SEQ ID NO: 12019 - protein, 104 aa, Artificial Sequence
  Description of Artificial Sequence: Synthetic coding sequence
SALTRLASFARVGGRLFRSGCARTAGDGGVRHAGGGVHIEPRYRQFPQLTRSQVFQSEFFSGLMWFWILWRFWHDSEEVLGHFPYPDPSQWTDEELGIPPDDED

SEQ ID NO: 12020 - protein, 105 aa, Artificial Sequence; identical to SEQ ID NO: 12018
  Description of Artificial Sequence: Synthetic coding sequence

SEQ ID NO: 12021 - protein, 105 aa, Artificial Sequence; identical to SEQ ID NO: 12018
  Description of Artificial Sequence: Synthetic coding sequence

SEQ ID NO: 12022 - protein, 129 aa, Artificial Sequence
  Description of Artificial Sequence: Synthetic coding sequence
MSFPKYKPSSLRTLPETLDPAEYNISPETRRAQAERLAIRAQLKREYLLQYNDPNRRGLIENPALLRWAYARTINVYPNFRPTPKNSLMGALCGFGPLIFIYYIIKTERDRKEKLIQEGKLDRTFHLSY

SEQ ID NO: 12023 - protein, 120 aa, Artificial Sequence
  Description of Artificial Sequence: Synthetic coding sequence
MSFPKYKPSSLRTLPETLDPAEYNISPETRRAQAERLAIRAQLKREYLLQYNDPNRRGLIENPALLRWAYARTINVYPNFRPTPKNSLMGALCGFGPLIFIYYIIKTERVSIQTRCLVFE

SEQ ID NO: 12024 - protein, 189 aa, Artificial Sequence
  Description of Artificial Sequence: Synthetic coding sequence
MAAMSLLRRVSVTAVAALSGRPLGTRLGFGGFLTRGFPKAAAPVRHSGDHGKRLFVIRPSRFYDRRFLKLLRFYIALTGIPVAIFITLVNVFIGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 12025 - protein, 137 aa, Artificial Sequence
  Description of Artificial Sequence: Synthetic coding sequence
MAAMSLLRRVSVTAVAALSGRPLGTRLGFGGFLTRGFPKAAGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 12026 - protein, 113 aa, Artificial Sequence
  Description of Artificial Sequence: Synthetic coding sequence
MTGYTPDEKLRLQQLRELRRRWLKDQELSPREPVLPPQKMGPMEKFWNKFLENKSPWRKMVHGVYKKSIFVFTHVLVPVWIIHYYMKYHVSGDTILETGEVIPPMKEFPDQHH

SEQ ID NO: 12027 - protein, 96 aa, Artificial Sequence
  Description of Artificial Sequence: Synthetic coding sequence
MIARRNPEPLRFLPDEARSLPPPKLTDPRLLYIGFLGYCSGLIDNLIRRRPIATADYLYAVRDREMFGYMKLHPEDFPEEDKKTYGEIFEKFHPIR

SEQ ID NO: 12028 - protein, 88 aa, Artificial Sequence
  Description of Artificial Sequence: Synthetic coding sequence
MIARRNPEPLRFLPDEARSLPPPKLTDPRLLYIGFLGYCSGLIDNLIRRRPIATAGLHRQLLYITAFFFAGYYLVKLEAYANLYVDTL

SEQ ID NO: 12029 - protein, 119 aa, Artificial Sequence
  Description of Artificial Sequence: Synthetic coding sequence
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEDKKTYGEIFEKFHPIR

SEQ ID NO: 12030 - protein, 76 aa, Artificial Sequence
  Description of Artificial Sequence: Synthetic coding sequence
MIARRNPEPLRFLPDEARSLPPPKLTDPRLLYIGFLGYCSGLIDNLIRRRPIATAGLHRQLLYITAFFCWILSCKT

SEQ ID NO: 12031 - protein, 343 aa, Artificial Sequence
  Description of Artificial Sequence: Synthetic coding sequence
MSVLLRSGLGPLCAVARAAIPFIWRGKYFSSGNEPAENPVTPMLRHLMYKIKSTGPITVAEYMKEVLTNPAKLLGIWFISEWMATGKSTAFQLVELGPGRGTLVGDILRVFTQLGSVLKNCDISVHLVEKTPQGWREVFVDIDPQVSDKLRFVLAPSATPAEAFIQHDETRDHVEVCPDAGVIIEELSQRIALTGGAALVADYGHDGTKTDTFRGFCDHKLHDVLIAPGTADLTADVDFSYLRRMAQGKVASLGPIKQHTFLKNMGIDVRLKVLLDKSNEPSVRQQLLQGYDMLMNPKKMGERFNFFALLPHQRLQGGRYQRNARQSKPFASVVAGFSELAWQ

SEQ ID NO: 12032 - protein, 483 aa, Artificial Sequence
  Description of Artificial Sequence: Synthetic coding sequence
MASLGDLVRAWHLGAQAVDRGDWARALHLFSGVPAPPARLCFNAGCVHLLAGDPEAALRAFDQAVTKDTCMAVGFFQRGVANFQLARFQEALSDFWLALEQLRGHAAIDYTQLGLRFKLQAWEVLHNVASAQCQLGLWTEAASSLREAMSKWPEGSLNGLDSALDQVQRRGSLPPRQVPRGEVFRPHRWHLKHLEPVDFLGKAKVVASAIPDDQGWGVRPQQPQGPGANHDARSLIMDSPRAGTHQGPLDAETEVGADRCTSTAYQEQRPQVEQVGKQAPLSPGLPAMGGPGPGPCEDPAGAGGAGAGGSEPLVTVTVQCAFTVALRARRGADLSSLRALLGQALPHQAQLGQLSYLAPGEDGHWVPIPEEESLQRAWQDAAACPRGLQLQCRGAGGRPVLYQVVAQHSYSAQGPEDLGFRQGDTVDVLCEEPDVPLAVDQAWLEGHCDGRIGIFPKCFVVPAGPRMSGAPGRLPRSQQGDQP

SEQ ID NO: 12033 - protein, 427 aa, Artificial Sequence
  Description of Artificial Sequence: Synthetic coding sequence
MASLGDLVRAWHLGAQAVDRGDWARALHLFSGVPAPPARLCFNAGCVHLLAGDPEAALRAFDQAVTKDTCMAVGFFQRGVANFQLARFQEALSDFWLALEQLRGHAAIDYTQLGLRFKLQAWEVLHNVASAQCQLGLWTEAASSLREAMSKWPEGSLNGLDSALDQVQGPGANHDARSLIMDSPRAGTHQGPLDAETEVGADRCTSTAYQEQRPQVEQVGKQAPLSPGLPAMGGPGPGPCEDPAGAGGAGAGGSEPLVTVTVQCAFTVALRARRGADLSSLRALLGQALPHQAQLGQLSYLAPGEDGHWVPIPEEESLQRAWQDAAACPRGLQLQCRGAGGRPVLYQVVAQHSYSAQGPEDLGFRQGDTVDVLCEEPDVPLAVDQAWLEGHCDGRIGIFPKCFVVPAGPRMSGAPGRLPRSQQGDQP

SEQ ID NO: 12034 - protein, 370 aa, Artificial Sequence
  Description of Artificial Sequence: Synthetic coding sequence
MAGPRYPVSVQGAALVQIKRLQTFAFSVRWSDGSDTFVRRSWDEFRQLKTLKETFPVEAGLLRRSDRVLPKLLDAPLLGRVGRTSRGLARLQLLETYSRRLLATAERVARSPTITGFFAPQPLDLEPALPPGSRVILPTPEEQPLSRAAGRLSIHSLEAQSLRCLQPFCTQDTRDRPFQAQAQESLDVLLRHPSGWWLVENEDRQTAWFPAPYLEEAAPGQGREGGPSLGSSGPQFCASRAYESSRADELSVPAGARVRVLETSDRGWWLCRYGDRAGLLPAVLLRPEGLGALLSGTGFRGGDDPAGEARGFPEPSQATAPPPTVPTRPSPGAIQSRCCTVTRRALERRPRRQGRPRGCVDSVPHPTTEQ

SEQ ID NO: 12035 - protein, 371 aa, Artificial Sequence
  Description of Artificial Sequence: Synthetic coding sequence
MAGPRYPVSVQGAALVQIKRLQTFAFSVRWSDGSDTFVRRSWDEFRQLKKTLKETFPVEAGLLRRSDRVLPKLLDAPLLGRVGRTSRGLARLQLLETYSRRLLATAERVARSPTITGFFAPQPLDLEPALPPGSRVILPTPEEQPLSRAAGRLSIHSLEAQSLRCLQPFCTQDTRDRPFQAQAQESLDVLLRHPSGWWLVENEDRQTAWFPAPYLEEAAPGQGREGGPSLGSSGPQFCASRAYESSRADELSVPAGARVRVLETSDRGWWLCRYGDRAGLLPAVLLRPEGLGALLSGTGFRGGDDPAGEARGFPEPSQATAPPPTVPTRPSPGAIQSRCCTVTRRALERRPRRQGRPRGCVDSVPHPTTEQ

SEQ ID NO: 12036 - protein, 376 aa, Artificial Sequence
  Description of Artificial Sequence: Synthetic coding sequence
MAGPRYPVSVQGAALVQIKRLQTFAFSVRWSDGSDTFVRRSWDEFRQLKKTLKETFPVEAGLLRRSDRVLPKLLGQASLDAPLLGRVGRTSRGLARLQLLETYSRRLLATAERVARSPTITGFFAPQPLDLEPALPPGSRVILPTPEEQPLSRAAGRLSIHSLEAQSLRCLQPFCTQDTRDRPFQAQAQESLDVLLRHPSGWWLVENEDRQTAWFPAPYLEEAAPGQGREGGPSLGSSGPQFCASRAYESSRADELSVPAGARVRVLETSDRGWWLCRYGDRAGLLPAVLLRPEGLGALLSGTGFRGGDDPAGEARGFPEPSQATAPPPTVPTRPSPGAIQSRCCTVTRRALERRPRRQGRPRGCVDSVPHPTTEQ

SEQ ID NO: 12037 - protein, 470 aa, Artificial Sequence
  Description of Artificial Sequence: Synthetic coding sequence
MGKLHSKPAAVCKRRESPEGDSFAVSAAWARKGIEEWIGRQRCPGGVSGPRQLRLAGTIGRSTRELVGDVLRDTLSEEEEDDFRLEVALPPEKTDGLGSGDEKKMERVSEPCPGSKKQLKFEELQCDVSMEEDSRQEWTFTLYDFDNNGKVTREDITSLLHTIYEVVDSSVNHSPTSSKMLRVKLTVAPDGSQSKRSVLVNQADLQSARPRAETKPTEDLRSWEKKQRAPLRFQGDSRLEQSGCYHHCVDENIERRNHYLDLAGIENYTSQFGPGSPSVAQKSELPPRTSNPTRSRSHEPEAIHIPHRKPQGVDPASFHFLDTPIAKVSELQQRLRGTQDGSKHFVRSPKAQGKSVGVGHVARGARNKPPLGPAIPAVSPSAHLAASPALLPSLAPLGHKKHKHRAKESQQGCRGLQAPLASGGPVLGREHLRELPALVVYESQAGQPVQRHEHHHHHEHHHHYHHFYQT

SEQ ID NO: 12038 - protein, 451 aa, Artificial Sequence
  Description of Artificial Sequence: Synthetic coding sequence
MGKLQSKHAAAARKRRESPEGDSFVASAYASGRKGAEEAERRARDKQELPNGDPKEGPFREDQCPLQVALPAEKAEGREHPGQLLSADDGERAANREGPRGPGGQRLNIDALQCDVSVEEDDRQEWTFTLYDFDNCGKVTREDMSSLMHTIYEVVDASVNHSSGSSKTLRVKLTVSPEPSSKRKEGPPAGQDREPTRCRMEGELAEEPRVADRRLSAHVRRPSTDPQPCSERGPYCVDENTERRNHYLDLAGIENYTSRFGPGSPPVQAKQEPQGRASHLQARSRSQEPDTHAVHHRRSQVLVEHVVPASEPAARALDTQPRPKGPEKQFLKSPKGSGKPPGVPASSKSGKAFSYYLPAVLPPQAPQDGHHLPQPPPPPYGHKRYRQKGREGHSPLKAPHAQPATVEHEVVRDLPPTPAGEGYAVPVIQRHEHHHHHEHHHHHHHHHFHPS

SEQ ID NO: 12039 - protein, 168 aa, Artificial Sequence
  Description of Artificial Sequence: Synthetic coding sequence
MAGSVDNRQCGRQGRQCGQQTVSTAGSVDGRQAVWMAGSVDACHSGARGGAGPAAHASRRGLRGASDPAARAPPPPRAPPPPPPPPLPPVLAPLPSTPRSQHTTARDLRAGSRAAAGCVPMGSPAPTPHLRQQTATDCRCWHDGGGAPWTRGQGPGALCSSALDATWR

SEQ ID NO: 12040 - protein, 311 aa, Artificial Sequence
  Description of Artificial Sequence: Synthetic coding sequence
MGKLQSKHAAAARKRRESPEGDSFVASAYASGRKGAEEAERRARDKQELPNGDPKEGPFREDQCPLQVALPAEKAEGREHPGQLLSADDGERAANREGPRGPGGQRLNIDALQCDVSVEEDDRQEWTFTLYDFDNCGKVTREDMSSLMHTIYEVVDASVNHSSGSSKTLRVKLTVSPEPSSKRKEGPPAGQDREPTRCRMEGELAEEPRVADRRLSAHVRRPSTDPQPCSERGPYCVDENTERRNHYLDLAGIENYTSRFGPGSQLCEKRSSAPRTHSGDKARGVGLCRELWSQAGHPQWPGPFPSGLVAV

SEQ ID NO: 12041 - protein, 311 aa, Artificial Sequence; identical to SEQ ID NO: 12040
  Description of Artificial Sequence: Synthetic coding sequence

SEQ ID NO: 12042 - protein, 165 aa, Artificial Sequence
  Description of Artificial Sequence: Synthetic coding sequence
MELCRSLALLGGSLGLMFCLIALSTDFWFEAVGPTHSAHSGLWPTGHGDIISGYIHVTQTFSIMAVLWALVSVSFLVLSCFPSLFPPGHGPLVSTTAAFAAAISMVVAMAVYTSERWDQPPHPQIQTFFSWSFYLGWVSAILLLCTGALSLGAHCGGPRPGYETL

SEQ ID NO: 12043 - protein, 377 aa, Artificial Sequence
  Description of Artificial Sequence: Synthetic coding sequence
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSPNDFSVSLKAQGKNKHFKVQLKETVYCIGQRKFSTMEELVEHYKKAPIFTSEQGEKLYLVKHLS

SEQ ID NO: 12044 - protein, 75 aa, Artificial Sequence
  Description of Artificial Sequence: Synthetic coding sequence
MAEEVVVVAKFDYVAQQEQELDIKKNERLWLLDDSKSWWRVRNSMNKTGFVPSNYVERKNSARKASIVKNLKDTL

SEQ ID NO: 12045 - protein, 377 aa, Artificial Sequence; identical to SEQ ID NO: 12043
  Description of Artificial Sequence: Synthetic coding sequence

SEQ ID NO: 12046 - protein, 115 aa, Artificial Sequence
  Description of Artificial Sequence: Synthetic coding sequence
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKF

SEQ ID NO: 12047 - protein, 129 aa, Artificial Sequence
  Description of Artificial Sequence: Synthetic coding sequence
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIK

SEQ ID NO: 12048 - protein, 313 aa, Artificial Sequence
  Description of Artificial Sequence: Synthetic coding sequence
MDWLNVFKDFFSIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSPNDFSVSLKAQGKNKHFKVQLKETVYCIGQRKFSTMEELVEHYKKAPIFTSEQGEKLYLVKHLS

SEQ ID NO: 12049 - protein, 1127 aa, Artificial Sequence
  Description of Artificial Sequence: Synthetic coding sequence
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 12050 - protein, 1077 aa, Artificial Sequence
  Description of Artificial Sequence: Synthetic coding sequence
MEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 12051 - protein, 873 aa, Artificial Sequence
  Description of Artificial Sequence: Synthetic coding sequence
MSFIMKLHRHFQRTVILLATFCMVSIIISAYYLYSGYKQENELSETASEVDCGDLQHLPYQLMEVKAMKLFDASRTDPTVLVFVESQYSSLGQDIIMILESSRFQYHIEIAPGKGDLPVLIDKMKGKYILIIYENILKYINMDSWNRSLLDKYCVEYGVGVIGFHKTSEKSVQSFQLKGFPFSIYGNLAVKDCCINPHSPLIRVTKSSKLEKGSLPGTDWTVFQINHSAYQPVIFAKVKTPENLSPSISKGAFYATIIHDLGLHDGIQRVLFGNNLNFWLHKLIFIDAISFLSGKRLTLSLDRYILVDIDDIFVGKEGTRMNTNDVKALLDTQNLLRAQITNFTFNLGFSGKFYHTGTEEEDEGDDCLLGSVDEFWWFPHMWSHMQPHLFHNESSLVEQMILNKKFALEHGIPTDMGYAVAPHHSGVYPVHVQLYEAWKKVWNIKITSTEEYPHLKPARYRRGFIHKNIMVLPRQTCGLFTHTIFYKEYPGGPKELDKSIQGGELFFTVVLNPISIFMTHLSNYGNDRLGLYTFVNLANFVKSWTNLRLQTLPPVQLAHKYFELFPDQKDPLWQNPCDDKRHRDIWSKEKTCDRLPKFLVIGPQKTGTTALYLFLVMHPSILSNSPSPKTFEEVQFFNRNNYHRGIDWYMDFFPVPSNVTTDFLFEKSANYFHSEEAPKRAASLVPKAKIITILIDPSDRAYSWYQHQRSHEDPAALKFSFYEVISAGPRAPSELRALQKRCLVPGWYASHIERWLVYFPPFQLLIIDGQQLRTDPATVMDEVQKFLGVLPHYNYSEALTFDSHKGFWCQLLEEGKTKCLGKSKGRKYPPMDSDSRTFLSSYYRDHNVELSKLLHKLGQPLPSWLRQELQKVR

SEQ ID NO: 12052 - protein, 561 aa, Artificial Sequence
  Description of Artificial Sequence: Synthetic coding sequence
MSFIMKLHRHFQRTVILLATFCMVSIIISAYYLYSGYKQENELSETASEVDCGDLQHLPYQLMEVKAMKLFDASRTDPTVLVFVESQYSSLGQDIIMILESSRFQYHIEIAPGKGDLPVLIDKMKGKYILIIYENILKYINMDSWNRSLLDKYCVEYGVGVIGFHKTSEKSVQSFQLKGFPFSIYGNLAVKDCCINPHSPLIRVTKSSKLEKGSLPGTDWTVFQINHSAYQPVIFAKVKTPENLSPSISKGAFYATIIHDLGLHDGIQRVLFGNNLNFWLHKLIFIDAISFLSGKRLTLSLDRYILVDIDDIFVGKEGTRMNTNDVKEHGIPTDMGYAVAPHHSGVYPVHVQLYEAWKKVWNIKITSTEEYPHLKPARYRRGFIHKNIMVLPRQTCGLFTHTIFYKEYPGGPKELDKSIQGGELFFTVVLNPISIFMTHLSNYGNDRLGLYTFVNLANFVKSWTNLRLQTLPPVQLAHKYFELFPDQKDPLWQNPCDDKRHRDIWSKEKTCDRLPKFLVIGPQKTGTTALYLFLVMHPSILSNSPSPKTFEEVYGFLPSPI

SEQ ID NO: 12053 - protein, 872 aa, Artificial Sequence
  Description of Artificial Sequence: Synthetic coding sequence
MNLIVKLRRSFRTLIVLLATFCLVSIVISAYFLYSGYKQEMTLIETTAEAECTDIKILPYRSMELKTVKPIDTSKTDPTVLLFVESQYSQLGQDIIAILESSRFQYHMVIAPGKGDIPPLTDNGKGKYTLVIYENILKYVSMDSWNRELLEKYCVEYSVSIIGFHKANENSLPSTQLKGFPLNLFNNLALKDCFVNPQSPLLHITKAPKVEKGPLPGEDWTIFQYNHSTYQPVLLTELQTEKSLSSLSSKTLFATVIQDLGLHDGIQRVLFGNNLNFWLHKLIFIDAISFLSGKRLTLSLDRYILVDIDDIFVGKEGTRMNVKDVKALLETQNLLRTQVANFTFNLGFSGKFYHTGTEEEDEGDDLLLRSVDEFWWFPHMWSHMQPHLFHNESSLVEQMILNKEFALEHGIPINMGYAVAPHHSGVYPVHIQLYAAWKKVWGIQVTSTEEYPHLKPARYRKGFIHNSIMVLPRQTCGLFTHTIFYKEYPGGPQELDKSIRGGELFLTILLNPISIFMTHLSNYGNDRLGLYTFVNLVNFVQSWTNLKLQTLPPVQLAHQYFELFPEQKDPLWQNPCDDKRHKDIWSREKTCDHLPKFLVIGPQKTGTTALYLFLLMHPSIISNLPSPKTFEEVQFFNGNNYHKGIDWYMDFFPTPSNTTSDFLFEKSANYFHSEEAPRRAASLVPKAKIITILIDPSDRAYSWYQHQRSHEDPAALRFNFYEVISTGHWAPSDLKTLQRRCLVPGWYAVHIERWLTYFATSQLLIIDGQQLRSDPATVMDEVQKFLGVTPRYNYSEALTFDPQKGFWCQLLEGGKTKCLGKSKGRKYPPMDPESRTFLSNYYRDHNVELSKLLHRLGQPLPSWLRQELQKVR

SEQ ID NO: 12054 - protein, 544 aa, Artificial Sequence
  Description of Artificial Sequence: Synthetic coding sequence
MATAPGPAGIAMGSVGSLLERQDFSPEELRAALAGSRGSRQPDGLLRKGLGQREFLSYLHLPKKDSKSTKNTKRAPRNEPADYATLYYREHSRAGDFSKTSLPERGRFDKCRIRPSVFKPTAGNGKGFLSMQSLASHKGQKLWRSNGSLHTLACHPPLSPGPRASQARAQLLHALSLDEGGPEPEPSLSDSSSGGSFGRSPGTGPSPFSSSLGHLNHLGGSLDRASQGPKEAGPPAVLSCLPEPPPPYEFSCSSAEEMGAVLPETCEELKRGLGDEDGSNPFTQVLEERQRLWLAELKRLYVERLHEVTQKAERSERNLQLQLFMAQQEQRRLRKELRAQQGLAPEPRAPGTLPEADPSARPEEEARWEVCQKTAEISLLKQQLREAQAELAQKLAEIFSLKTQLRGSRAQAQAQDAELVRLREAVRSLQEQAPREEAPGSCETDDCKSRGLLGEAGGSEARDSAEQLRAELLQERLRGQEQALRFEQERRTWQEEKERVLRYQREIQGGYMDMYRRNQALEQELRALREPPTPWSPRLESSKI

SEQ ID NO: 12055 - protein, 312 aa, Artificial Sequence
  Description of Artificial Sequence: Synthetic coding sequence
MAAQKINEGLEHLAKAEKYLKTGFLKWKPDYDSAASEYGKAAVAFKNAKQFEQAKDACLREAVAHENNRALFHAAKAYEQAGMMLKEMQKLPEAVQLIEKASMMYLENGTPDTAAMALERAGKLIENVDPEKAVQLYQQTANVFENEERLRQAVELLGKASRLLVRGRRFDEAALSIQKEKNIYKEIENYPTCYKKTIAQVLVHLHRNDYVAAERCVRESYSIPGFNGSEDCAALEQLLEGYDQQDQDQVSDVCNSPLFKYMDNDYAKLGLSLVVPGGGIKKKSPATPQAKPDGVTATAADEEEDEYSGGLC

SEQ ID NO: 12056 - protein, 230 aa, Artificial Sequence
  Description of Artificial Sequence: Synthetic coding sequence
MMLKEMQKLPEAVQLIEKASMMYLENGTPDTAAMALERAGKLIENVDPEKAVQLYQQTANVFENEERLRQAVELLGKASRLLVRGRRFDEAALSIQKEKNIYKEIENYPTCYKKTIAQVLVHLHRNDYVAAERCVRESYSIPGFNGSEDCAALEQLLEGYDQQDQDQVSDVCNSPLFKYMDNDYAKLGLSLVVPGGGIKKKSPATPQAKPDGVTATAADEEEDEYSGGLC

SEQ ID NO: 12057 - protein, 536 aa, Artificial Sequence
  Description of Artificial Sequence: Synthetic coding sequence
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACTAPSGTFSKDAFLHCECYGHSNRCSYIDFLNVVTCVSCKHNTRGQHCQHCRLGYYRNGSAELDDENVCIECNCNQIGSVHDRCNETGFCECREGAAGPKCDDCLPTHYWRQGCYPNVCDDDQLLCQNGGTCLQNQRCACPRGYTGVRCEQPRCDPADDDGGLDCDRAPGAAPRPATLLGCLLLLGLAARLGR

SEQ ID NO: 12058 - protein, 422 aa, Artificial Sequence
  Description of Artificial Sequence: Synthetic coding sequence
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACATAGSFGTLQTPPPGRSPSALRGSRRGLANVKEPAGSRPQISEMLLGCTVTLHQGSVGPHIPPKLSLPDPGGPWLGSQ

SEQ ID NO: 12059 - protein, 522 aa, Artificial Sequence
  Description of Artificial Sequence: Synthetic coding sequence
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNAYCECYGHSNRCSYIDFLNVVTCVSCKHNTRGQHCQHCRLGYYRNGSAELDDENVCIECNCNQIGSVHDRCNETGFCECREGAAGPKCDDCLPTHYWRQGCYPNVCDDDQLLCQNGGTCLQNQRCACPRGYTGVRCEQPRCDPADDDGGLDCDRAPGAAPRPATLLGCLLLLGLAARLGR

SEQ ID NO: 12060 - protein, 530 aa, Artificial Sequence
  Description of Artificial Sequence: Synthetic coding sequence
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACATAGSFGNCECYGHSNRCSYIDFLNVVTCVSCKHNTRGQHCQHCRLGYYRNGSAELDDENVCIECNCNQIGSVHDRCNETGFCECREGAAGPKCDDCLPTHYWRQGCYPNVCDDDQLLCQNGGTCLQNQRCACPRGYTGVRCEQPRCDPADDDGGLDCDRAPGAAPRPATLLGCLLLLGLAARLGR

SEQ ID NO: 12061 - protein, 285 aa, Artificial Sequence
  Description of Artificial Sequence: Synthetic coding sequence
MAAASEPVDSGALWGLERPEPPPTRFHRVHGANIRVDPSGTRATRVESFAHGVCFSREPLAPGQVFLVEIEEKELGWCGHLRLGLTALDPASLAPVPEFSLPDLVNLGHTWVFAITRHHNRVPREGRPEAEAAAPSRPPTLLVEPYLRIEQFRIPRDRLVGRSRPGLYSHLLDQLYELNVLPPTARRSRLGVLFCPRPDGTADMHIIINGEDMGPSARGLPAAQPLYAVVDVFASTKSVRLVQLEYGLPSLQTLCRLVIQRSMVHRLAIDGLHLPKELKDFCKYE

SEQ ID NO: 12062 - protein, 146 aa, Artificial Sequence
  Description of Artificial Sequence: Synthetic coding sequence
MSSCSNVCGSRQAQAAAEGGYQRYGVRSYLHQFYEDCTASIWEYEDDFQIQRSPNRWSSVFWKQELGFHTSSHSQEWNRKLQHKNCPRCCFGSLSPPGEALLCRHWDWPYHPKAPGCSAEPGGGPFQSIPTLLCGPKRGCFASSEL

SEQ ID NO: 12063 - protein, 177 aa, Artificial Sequence
  Description of Artificial Sequence: Synthetic coding sequence
MSSCSNVCGSRQAQAAAEGGYQRYGVRSYLHQFYEDCTASIWEYEDDFQIQRSPNRWSSVFWKVGLISGTVFVILGLTVLAVGFLVPPKIEAFGEADFVVVDTHAVQFNSALDMYKLAGAVLFCIGGTSMAGCLLMSVFVKSYSKEEKFLQQKFKERIADIKAHTQPVTKAPGTPLS

SEQ ID NO: 12064 - protein, 146 aa, Artificial Sequence; identical to SEQ ID NO: 12062
  Description of Artificial Sequence: Synthetic coding sequence

SEQ ID NO: 12065 - protein, 195 aa, Artificial Sequence
  Description of Artificial Sequence: Synthetic coding sequence
MSSCSNVCGSRQAQAAAEGGYQRYGVRSYLHQFYEDCTASIWEYEDDFQIQRSPNRWSSVFWKVGLISGTVFVILGLTVLAVGFLVPPKIEAFGEADFVVVDTHAVQFNSALDMYKLAGAVLFCIGGTSMAGCLLMSVFVKSYSKEEKFLQQKFKERIADIKAHTQPVTKAPGPGETKIPVTLSRVQNVQPLLAT

SEQ ID NO: 12066 - protein, 165 aa, Artificial Sequence
  Description of Artificial Sequence: Synthetic coding sequence
MMRCCRRRCCCRQPPHALRPLLLLPLVLLPPLAAAAAGPNRCDTIYQGFAECLIRLGDSMGRGGELETICRSWNDFHACASQVLSGCPEEAAAVWESLQQEARQAPRPNNLHTLCGAPVHVRERGTGSETNQETLRATAPALPMAPAPPLLAAALALAYLLRPLA

SEQ ID NO: 12067 - protein, 816 aa, Artificial Sequence
  Description of Artificial Sequence: Synthetic coding sequence
MSRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 12068 - protein, 816 aa, Artificial Sequence; identical to SEQ ID NO: 12067
  Description of Artificial Sequence: Synthetic coding sequence

SEQ ID NO: 12069 - protein, 836 aa, Artificial Sequence
  Description of Artificial Sequence: Synthetic coding sequence
MSRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDGANTKKNADDITSNDRGEDEDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 12070 - protein, 816 aa, Artificial Sequence; identical to SEQ ID NO: 12067
  Description of Artificial Sequence: Synthetic coding sequence

SEQ ID NO: 12071 - protein, 816 aa, Artificial Sequence; identical to SEQ ID NO: 12067
  Description of Artificial Sequence: Synthetic coding sequence

SEQ ID NO: 12072 - protein, 185 aa, Artificial Sequence
  Description of Artificial Sequence: Synthetic coding sequence
MVKLGNNFAEKGTKQPLLEDGFDTIPLMTPLDVNQLQFPPPDKVVVKTKTEYEPDRKKGKARPPQIAEFTVSITEGVTERFKVSVLVLFALAFLTCVVFLVVYKVYKYDRACPDGFVLKNTQCIPEGLESYYAEQDSSAREKFYTVINHYNLAKQSITRSVSPWMSVLSEEKLSEQETEAAEKSA

SEQ ID NO: 12073 - protein, 185 aa, Artificial Sequence; identical to SEQ ID NO: 12072
  Description of Artificial Sequence: Synthetic coding sequence

SEQ ID NO: 12074 - protein, 185 aa, Artificial Sequence; identical to SEQ ID NO: 12072
  Description of Artificial Sequence: Synthetic coding sequence

SEQ ID NO: 12075 - protein, 146 aa, Artificial Sequence
  Description of Artificial Sequence: Synthetic coding sequence
MVKLGNNFAEKGTKQPLLEDGFDTIPLMTPLDVNQLQFPPPDKVSVLVLFALAFLTCVVFLVVYKVYKYDRACPDGFVLKNTQCIPEGLESYYAEQDSSAREKFYTVINHYNLAKQSITRSVSPWMSVLSEEKLSEQETEAAEKSA

SEQ ID NO: 12076 - protein, 185 aa, Artificial Sequence; identical to SEQ ID NO: 12072
  Description of Artificial Sequence: Synthetic coding sequence

SEQ ID NO: 12077 - protein, 185 aa, Artificial Sequence; identical to SEQ ID NO: 12072
  Description of Artificial Sequence: Synthetic coding sequence

SEQ ID NO: 12078 - protein, 185 aa, Artificial Sequence; identical to SEQ ID NO: 12072
  Description of Artificial Sequence: Synthetic coding sequence

SEQ ID NO: 12079 - protein, 185 aa, Artificial Sequence; identical to SEQ ID NO: 12072
  Description of Artificial Sequence: Synthetic coding sequence

SEQ ID NO: 12080 - protein, 171 aa, Artificial Sequence
  Description of Artificial Sequence: Synthetic coding sequence
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEGFVYKHKRCIPASLDAYYSSQDPNSRSRFYTVISHYSVAKQSTARAIGPWLSAAAVIHEPKPPKTQGH

SEQ ID NO: 12081 - protein, 171 aa, Artificial Sequence; identical to SEQ ID NO: 12080
  Description of Artificial Sequence: Synthetic coding sequence

SEQ ID NO: 12082 - protein, 146 aa, Artificial Sequence
  Description of Artificial Sequence: Synthetic coding sequence
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEGFVYKHKRCIPASLDAYYSSQDPNSRSRFYTVISHYSVAKQST

SEQ ID NO: 12083 - protein, 159 aa, Artificial Sequence
  Description of Artificial Sequence: Synthetic coding sequence
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEGFVYKHKRCIPASLDAYYSSQDPNSRSRFYTVISHYSVAKQSTARAIGPWLSAAAV

SEQ ID NO: 12084 - protein, 430 aa, Artificial Sequence
  Description of Artificial Sequence: Synthetic coding sequence
MEGEPSQPPNSSWPLSQNGTNTEATPATNLTFSSYYQHTSPVAAMFIVAYALIFLLCMVGNTLVCFIVLKNRHMHTVTNMFILNLAVSDLLVGIFCMPTTLVDNLITGWPFDNATCKMSGLVQGMSVSASVFTLVAIAVERFRCIVHPFREKLTLRKALVTIAVIWALALLIMCPSAVTLTVTREEHHFMVDARNRSYPLYSCWEAWPEKGMRRVYTTVLFSHIYLAPLALIVVMYARIARKLCQAPGPAPGGEEAADPRASRRRARVVHMLVMVALFFTLSWLPLWALLLLIDYGQLSAPQLHLVTVYAFPFAHWLAFFNSSANPIIYGYFNENFRRGFQAAFRARLCPRPSGSHKEAYSERPGGLLHRRVFVVVRPSDSGLPSESGPSSGAPRPGRLPLRNGRVAHHGLPREGPGCSHLPLTIPAWDI

SEQ ID NO: 12085 - protein, 428 aa, Artificial Sequence
  Description of Artificial Sequence: Synthetic coding sequence
GEPSQPPNSSWPLSQNGTNTEATPATNLTFSSYYQHTSPVAAMFIVAYALIFLLCMVGNTLVCFIVLKNRHMHTVTNMFILNLAVSDLLVGIFCMPTTLVDNLITGWPFDNATCKMSGLVQGMSVSASVFTLVAIAVERFRCIVHPFREKLTLRKALVTIAVIWALALLIMCPSAVTLTVTREEHHFMVDARNRSYPLYSCWEAWPEKGMRRVYTTVLFSHIYLAPLALIVVMYARIARKLCQAPGPAPGGEEAADPRASRRRARVVHMLVMVALFFTLSWLPLWALLLLIDYGQLSAPQLHLVTVYAFPFAHWLAFFNSSANPIIYGYFNENFRRGFQAAFRARLCPRPSGSHKEAYSERPGGLLHRRVFVVVRPSDSGLPSESGPSSGAPRPGRLPLRNGRVAHHGLPREGPGCSHLPLTIPAWDI

SEQ ID NO: 12086 - protein, 522 aa, Artificial Sequence
  Description of Artificial Sequence: Synthetic coding sequence
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 12087 - protein, 132 aa, Artificial Sequence
  Description of Artificial Sequence: Synthetic coding sequence
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERMAIWKHDVQDQWIGPGNICRSFSLYVSCNCCR

SEQ ID NO: 12088 - protein, 420 aa, Artificial Sequence
  Description of Artificial Sequence: Synthetic coding sequence
MNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 12089 - protein, 423 aa, Artificial Sequence
  Description of Artificial Sequence: Synthetic coding sequence
MFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 12090 - protein, 333 aa, Artificial Sequence
  Description of Artificial Sequence: Synthetic coding sequence
MQAAGHPEPLDSRGSFSLPTMGANVSQDNGTGHNATFSEPLPFLYVLLPAVYSGICAVGLTGNTAVILVILRAPKMKTVTNVFILNLAVADGLFTLVLPVNIAEHLLQYWPFGELLCKLVLAVDHYNIFSSIYFLAVMSVDRYLVVLATVRSRHMPWRTYRGAKVASLCVWLGVTVLVLPFFSFAGVYSNELQVPSCGLSFPWPEQVWFKASRVYTLVLGFVLPVCTICVLYTDLLRRLRAVRLRSGAKALGKARRKVTVLVLVVLAVCLLCWTPFHLASVVALTTDLPQTPLVISMSYVITSLSYANSCLNPFLYAFLDDNFRKNFRSILRC

SEQ ID NO: 12091 - protein, 525 aa, Artificial Sequence
  Description of Artificial Sequence: Synthetic coding sequence
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 12092 - protein, 525 aa, Artificial Sequence; identical to SEQ ID NO: 12091
  Description of Artificial Sequence: Synthetic coding sequence

SEQ ID NO: 12093 - protein, 410 aa, Artificial Sequence
  Description of Artificial Sequence: Synthetic coding sequence
METSSPRPPRPSSNPGLSLDARLGVDTRLWAKVLFTALYALIWALGAAGNALSAHVVLKARAGRAGRLRHHVLSLALAGLLLLLVGVPVELYSFVWFHYPWVFGDLGCRGYYFVHELCAYATVLSVAGLSAERCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSVQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 12094 - protein, 563 aa, Artificial Sequence
  Description of Artificial Sequence: Synthetic coding sequence
MLEEAGEVLENMLKASCLPLGFIVFLPAVLLLVAPPLPAADAAHEFTVYRMQQYDLQGQPYGTRNAVLNTEARTMAAEVLSRRCVLMRLLDFSYEQYQKALRQSAGAVVIILPRAMAAVPQDVVRQFMEIEPEMLAMETAVPVYFAVEDEALLSIYKQTQAASASQGSASAAEVLLRTATANGFQMVTSGVQSKAVSDWLIASVEGRLTGLGGEDLPTIVIVAHYDAFGVAPWLSLGADSNGSGVSVLLELARLFSRLYTYKRTHAAYNLLFFASGGGKFNYQGTKRWLEDNLDHTDSSLLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRSRVDSKTLTRNTRIIAEALTRVIYNLTEKGTPPDMPVFTEQMQIQQEQLDSVMDWLTNQPRAAQLVDKDSTFLSTLEHHLSRYLKDVKQHHVKADKRDPEFVFYDQLKQVMNAYRVKPAVFDLLLAVGIAAYLGMAYVAVQHFSLLYKTVQRLLVKAKTQ

SEQ ID NO: 12095 - protein, 410 aa, Artificial Sequence
  Description of Artificial Sequence: Synthetic coding sequence
MGAQVRLPPGEPCREGYVLSLVCPNSSQAWCEITNVSQLLASPVLYTDLNYSINNLSISANVENKYSLYVGLVLAVSSSIFIGSSFILKKKGLLQLASKGFTRAGQGGHSYLKEWLWWVGLLSMGAGEAANFAAYAFAPATLVTPLGALSVLISAILSSYFLNEHLNIHGKIGCILSILGSTVMVIHAPQEEEVTSLHEMEMKLRDPGFISFAVIITVISLVLILIVAPKKGQTNILVYISICSLIGAFSVSSVKGLGIAIKELIEWKPVYKHPLVFVLLAVLVLSVTTQINYLNKALDTFNTSLVTPIYYVFFTSMVVTCSAILFQEWYGMTAGDIIGTLSGFFTIIIGIFLLHAFKNTDITWSELTSTAKKEAVSLNVNENNYVLLENLECSAPGYNDDVTLFSRTDD

SEQ ID NO: 12096 - protein, 368 aa, Artificial Sequence
  Description of Artificial Sequence: Synthetic coding sequence
MAAVAPAGPGDSASAALDELSLNFTYGAPGAGNGSLSGDWYRRNQIHLFGVLLAILGNLVISISLNIQKYSHLQLAQQEHPRPYFKSVLWWGGVLLMAVGETGNFAAYGFAPITLIAPLGCVSVTGSAIISVTFLKDNLRASDLLGTTLAFAGTYLLVNFAPNITQAISARTVQYYLVGWQFLIYVILEILIFCILLYFYKRKGMKHMVILLTLVAILASLTVISVKAVSGMITFSVMDKMQLTYPIFYIMFIIMIASCVFQVKFLNQATKLYNTTTVVPVNHIFFTISAIIAGIIFYQEFLGAPFLTVFIYLFGCFLSFLGVFLVTRNREKEHLQQSYIDFGNIPDTTPERKAWRETNVGQNTTRFT

SEQ ID NO: 12097 - protein, 324 aa, Artificial Sequence
  Description of Artificial Sequence: Synthetic coding sequence
MLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPGMQNMHDKGMTVQPELKASFSYGALENNDNISEIYAPATLPVMQEEHGSRSASGVPYRVLEHTKKE

SEQ ID NO: 12098 - protein, 368 aa, Artificial Sequence
  Description of Artificial Sequence: Synthetic coding sequence
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPDSYLHNRQLLFKRYSNSRNLPHHNLESL

SEQ ID NO: 12099 - protein, 226 aa, Artificial Sequence
  Description of Artificial Sequence: Synthetic coding sequence
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLVLLCHPGWSAVVQS

SEQ ID NO: 12100 - protein, 406 aa, Artificial Sequence
  Description of Artificial Sequence: Synthetic coding sequence
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPGMQNMHDKGMTVQPELKASFSYGALENNDNISEIYAPATLPVMQEEHGSRSASGVPYRVLEHTKKE

SEQ ID NO: 12101 - protein, 226 aa, Artificial Sequence; identical to SEQ ID NO: 12099
  Description of Artificial Sequence: Synthetic coding sequence

SEQ ID NO: 12102 - protein, 134 aa, Artificial Sequence
  Description of Artificial Sequence: Synthetic coding sequence
  MOD_RES (1)..(1): Any amino acid
XVAGMLVLSIQGNLQLDYPIFYVMFVCMVATAVYQAAFSKTDSSPANENNSPYLRESHEALMRMSLGKCPVFESSLTDVRLLFDCQCGLHSVHNHCYHSRCNILPGLHRGGRAAHLHVCTGVPHCILGRLLNHA

SEQ ID NO: 12103 - protein, 1504 aa, Artificial Sequence
  Description of Artificial Sequence: Synthetic coding sequence
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSVSEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPAEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 12104 - protein, 818 aa, Artificial Sequence
  Description of Artificial Sequence: Synthetic coding sequence
MGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPAEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSAESREKLISLLARQWEALCGRELPVELTG

SEQ ID NO: 12105 - protein, 428 aa, Artificial Sequence
  Description of Artificial Sequence: Synthetic coding sequence
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 12106 - protein, 1504 aa, Artificial Sequence; identical to SEQ ID NO: 12103
  Description of Artificial Sequence: Synthetic coding sequence

SEQ ID NO: 12107 - protein, 583 aa, Artificial Sequence
  Description of Artificial Sequence: Synthetic coding sequence
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSVSEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGNRVCILLLVEPHSPAWAPWLGWGWGRGASTCFQQGQTQGGQCLLQAGPRGGTHGRGAWPDASCCLLGEDSQLL

SEQ ID NO: 12108 - protein, 698 aa, Artificial Sequence
  Description of Artificial Sequence: Synthetic coding sequence
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMAGFPPLVAEDIMLKEGLGASEAVADIKFSSAGWVSVTPNFKDRLHLRGYTPEGTVLTVRPPLLPYIVNIKGQRIKKSVAYKTKKPPSLMYNVRKKKGKINV

SEQ ID NO: 12109 - protein, 1222 aa, Artificial Sequence
  Description of Artificial Sequence: Synthetic coding sequence
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRT

SEQ ID NO: 12110 - protein, 1267 aa, Artificial Sequence
  Description of Artificial Sequence: Synthetic coding sequence
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRTLRLQGEFQLTWCLVPWRGTLGIHLFSSLPFASEILLETTATCIHY

SEQ ID NO: 12111 - protein, 1100 aa, Artificial Sequence
  Description of Artificial Sequence: Synthetic coding sequence
MARFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRTLRLQGEFQLTWCLVPWRGTLGIHLFSSLPFASEILLETTATCIHY

SEQ ID NO: 12112 - protein, 1222 aa, Artificial Sequence
  Description of Artificial Sequence: Synthetic coding sequence
MLVGQGAGLLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGRISIIRFPDTVKQMNKYKVVLSSQDKDKSLVTVETDAHGSFCFKAKPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 12113 - protein, 1267 aa, Artificial Sequence
  Description of Artificial Sequence: Synthetic coding sequence
MLVGQGAGLLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGRISIIRFPDTVKQMNKYKVVLSSQDKDKSLVTVETDAHGSFCFKAKPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 12114 - protein, 1100 aa, Artificial Sequence
  Description of Artificial Sequence: Synthetic coding sequence
MARFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGRISIIRFPDTVKQMNKYKVVLSSQDKDKSLVTVETDAHGSFCFKAKPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 12115 - protein, 1267 aa, Artificial Sequence
  Description of Artificial Sequence: Synthetic coding sequence
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 12116 - protein, 1222 aa, Artificial Sequence
  Description of Artificial Sequence: Synthetic coding sequence
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 12117 - protein, 1100 aa, Artificial Sequence
  Description of Artificial Sequence: Synthetic coding sequence
MARFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 12118 - protein, 1401 aa, Artificial Sequence
  Description of Artificial Sequence: Synthetic coding sequence
MAPQMYEFHLPLSPEELLKSGGVNQYVVQEVLSIKHLPPQLRAFQAAFRAQGPLAMLQHFDTIYSILHHFRSIDPGLKEDTLQFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRSNLMVATGDLAIRFPNLVDPWTPHLYARLRDPAQQVRKTAGLVMTHLILKDMVKVKGQVSEMAVLLIDPEPQIAALAKNFFNELSHKGNAIYNLLPDIISRLSDPELGVEEEPFHTIMKQLLSYITKDKQTESLVEKLCQRFRTSRTERQQRDLAYCVSQLPLTERGLRKMLDNFDCFGDKLSDESIFSAFLSVVGKLRRGAKPEGKAIIDEFEQKLRACHTRGLDGIKELEIGQAGSQRAPSAKKPSTGSRYQPLASTASDNDFVTPEPRRTTRRHPNTQQRASKKKPKVVFSSDESSEEDLSAEMTEDETPKKTTPILRASARRHRS

SEQ ID NO: 12119 - protein, 939 aa, Artificial Sequence
  Description of Artificial Sequence: Synthetic coding sequence
MAPQMYEFHLPLSPEELLKSGGVNQYVVQEVLSIKHLPPQLRAFQAAFRAQGPLAMLQHFDTIYSILHLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQHFAIPRRVDNLR

SEQ ID NO: 12120 - protein, 1356 aa, Artificial Sequence
  Description of Artificial Sequence: Synthetic coding sequence
MLCKRYCPSNIFHHSLELFRLPFELRGPWLCCSTLILSTAFCMVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRSNLMVATGDLAIRFPNLVDPWTPHLYARLRDPAQQVRKTAGLVMTHLILKDMVKVKGQVSEMAVLLIDPEPQIAALAKNFFNELSHKGNAIYNLLPDIISRLSDPELGVEEEPFHTIMKQLLSYITKDKQTESLVEKLCQRFRTSRTERQQRDLAYCVSQLPLTERGLRKMLDNFDCFGDKLSDESIFSAFLSVVGKLRRGAKPEGKAIIDEFEQKLRACHTRGLDGIKELEIGQAGSQRAPSAKKPSTGSRYQPLASTASDNDFVTPEPRRTTRRHPNTQQRASKKKPKVVFSSDESSEEDLSAEMTEDETPKKTTPILRASARRHRS

SEQ ID NO: 12121 - protein, 370 aa, Artificial Sequence
  Description of Artificial Sequence: Synthetic coding sequence
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 12122 - protein, 372 aa, Artificial Sequence
  Description of Artificial Sequence: Synthetic coding sequence
MAAERQEALREFVAVTGAEEDRARFFLESAGWDLQIALASFYEDGGDEDIVTISQATPSSVSRGTAPSDNRVTSFRDLIHDQDEDEEEEEGQRDRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 12123 - protein, 339 aa, Artificial Sequence
  Description of Artificial Sequence: Synthetic coding sequence
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 12124 - protein, 259 aa, Artificial Sequence
  Description of Artificial Sequence: Synthetic coding sequence
MTKMKMRRKRKARGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 12125 - protein, 372 aa, Artificial Sequence
  Description of Artificial Sequence: Synthetic coding sequence
MAAERQEALREFVAVTGAEEDRARFFLESAGWDLQIALASFYEDGGDEDIVTISQATPSSVSRGTAPSDNRVTSFRDLIHDQDEDEEEEEGQRSRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 12126 - protein, 351 aa, Artificial Sequence
  Description of Artificial Sequence: Synthetic coding sequence
MEDSQETSPSSNNSSEELSSALHLSKGMSIFLDILRRADKNDDGKLSFEEFKAYFADGVLSGEELHELFHTIDTHNTNNLDTEELCEYFSQHLGEYENVLAALEDLNLSILKAMGKTKKDYQEASNLEQFVTRFLLKETLNQLQSLQNSLECAMETTEEQTRQERQGPAKPEVLSIQWPGKRSSRRVQRHNSFSPNSPQFNVSGPGLLEEDNQWMTQINRLQKLIDRLEKKDLKLEPPEEEIIEGNTKSHIMLVQRQMSVIEEDLEEFQLALKHYVESASSQSGCLRISIQKLSNESRYMIYEFWENSSVWNSHLQTNYSKTFQRSNVDFLETPELTSTMLVPASWWILNN

SEQ ID NO: 12127 - protein, 100 aa, Artificial Sequence
  Description of Artificial Sequence: Synthetic coding sequence
MLVQRQMSVIEEDLEEFQLALKHYVESASSQSGCLRISIQKLSNESRYMIYEFWENSSVWNSHLQTNYSKTFQRSNVDFLETPELTSTMLVPASWWILNN

SEQ ID NO: 12128 - protein, 100 aa, Artificial Sequence; identical to SEQ ID NO: 12127
  Description of Artificial Sequence: Synthetic coding sequence

SEQ ID NO: 12129 - protein, 832 aa, Artificial Sequence
  Description of Artificial Sequence: Synthetic coding sequence
MHKHYKVHFAKDAQSPNGHYFWDPELGHRKGCCHQWRQDSAALRAHGPCRPSPQSHWQLAYHSHQVGGSGWRRGLLPSVLQQQRQPQSQPSPPSPLRQRLCPIHEAQKGLPATSTVPKEPASAPQAPTLPTTAPAMARSGPALPSAAGVLLKPSEPTDARPLPAPAACGSFTAYSSDILTEDDVYCSCLAKTLCHVPVPVTVGFYAPFGCRLHMMLDKITALMQQEAAQRESEELQHVQWRPRAVSGWGVPQLLWYLVFLQPIITEVHLRRRNVQFLFIRFSAWQYAGTDKLWAGLVTTLCEGIRRHYGALPFSVYSVLGNKPATRQDCCQSEWHCRRRVCLGLLALLAALGLGVGLLYLSLGGHALGHGSPSGSLLKVFGGAATTLSGSGLLMAVYSVGKHLFVSQRKKIERLVSREKFGSQLGFMCEVKKEVELLTDFLCFLEIYQRRRLRVVLEVTGLDTCYPERVVGVLNAINTLLSDSHAPFIFILVVDPSILAACLESAGNMKGTADNGYLFLNRTVTLPFSVPIMGRRTKLQFLHDAVQSRDDLLYREMTRKPWLPGDAGGESAQLLAVQAQAGTERGQGRIDDEAARRIQEALFCLHDERDCLYEYVPDNVVSMRRIVNTVPITVRLLQQQQQQGDFGGPTPRQAVAWVVLANQWPCRLSWALQCLEDRQQTGGAPEGRARLWDVFRDNSRELHTMTKALQNVLDLDGDPELFERFLGADFPFTVAEAQSLLRCTVNLDHSIRRRMGLIRAVSALKPPSPPKSPTRDTPHAAHRANSASRAPPSGRASGQAGEGHHTGDLAHRGKLWPVACALFRPGQSSPGGP

SEQ ID NO: 12130 - protein, 531 aa, Artificial Sequence
  Description of Artificial Sequence: Synthetic coding sequence
MQQEAAQRESEELQHVQWRPRAVSGWGVPQLLWYLVFLQPIITEVHLRRRNVQFLFIRFSAWQYAGTDKLWAGLVTTLCEGIRRHYGALPFSVYSVLGNKPATRQDCCQSEWHCRRRVCLGLLALLAALGLGVGLLYLSLGGHALGHGSPSGSLLKVFGGAATTLSGSGLLMAVYSVGKHLFVSQRKKIERLVSREKFGSQLGFMCEVKKEVELLTDFLCFLEIYQRRRLRVVLEVTGLDTCYPERVVGVLNAINTLLSDSHAPFIFILVVDPSILAACLESAGNMKGTADNGYLFLNRTVTLPFSVPIMGRRTKLQFLHDAVQSRDDLLYREMTRKPWLPGDAGGESAQLLAVQAQAGTERGQGRIDDEAARRIQEALFCLHDERDCLYEYVPDNVVSMRRIVNTVPITVRLLQQQQQQGDFGGPTPRQAVAWVVLANQWPCRLSWALQCLEDRQQTGGAPEGRARLWDVFRDTPHAAHRANSASRAPPSGRASGQAGEGHHTGDLAHRGKLWPVACALFRPGQSSPGGP

SEQ ID NO: 12131 - protein, 610 aa, Artificial Sequence
  Description of Artificial Sequence: Synthetic coding sequence
MQQEAAQRESEELQHVQWRPRAVSGWGVPQLLWYLVFLQPIITEVHLRRRNVQFLFIRFSAWQYAGTDKLWAGLVTTLCEGIRRHYGALPFSVYSVLGNKPATRQDCCQSEWHCRRRVCLGLLALLAALGLGVGLLYLSLGGHALGHGSPSGSLLKVFGGAATTLSGSGLLMAVYSVGKHLFVSQRKKIERLVSREKFGSQLGFMCEVKKEVELLTDFLCFLEIYQRRRLRVVLEVTGLDTCYPERVVGVLNAINTLLSDSHAPFIFILVVDPSILAACLESAGNMKGTADNGYLFLNRTVTLPFSVPIMGRRTKLQFLHDAVQSRDDLLYREMTRKPWLPGDAGGESAQLLAVQAQAGTERGQGRIDDEAARRIQEALFCLHDERDCLYEYVPDNVVSMRRIVNTVPITVRLLQQQQQQGDFGGPTPRQAVAWVVLANQWPCRLSWALQCLEDRQQTGGAPEGRARLWDVFRDNSRELHTMTKALQNVLDLDGDPELFERFLGADFPFTVAEAQSLLRCTVNLDHSIRRRMGLIRAVSALKPPSPPKSPTRDTPHAAHRANSASRAPPSGRASGQAGEGHHTGDLAHRGKLWPVACALFRPGQSSPGGP

SEQ ID NO: 12132 - protein, 353 aa, Artificial Sequence
  Description of Artificial Sequence: Synthetic coding sequence
MRLRFWLLIWLLLGFISHQPTPVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMAAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRQREAEAQQLPKPKRRRLSKLRTRHCTQAWAIRINP

SEQ ID NO: 12133 - protein, 608 aa, Artificial Sequence
  Description of Artificial Sequence: Synthetic coding sequence
MAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSTVGGQLPGLHEYGAVGGSTHTATAAMWACQHCTFMNQPGTGHCEMCSLPRT

SEQ ID NO: 12134 - protein, 616 aa, Artificial Sequence
  Description of Artificial Sequence: Synthetic coding sequence
AEVVIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSEYPHPLPRHPVAGAGEQPTLHSSPLPVVPWIPHPAASWQVPSAMQRVETRPPCQARGRLR

SEQ ID NO: 12135 - protein, 456 aa, Artificial Sequence
  Description of Artificial Sequence: Synthetic coding sequence
MSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSEYPHPLPRHPVAGAGEQPTLHSSPLPVVPWIPHPAASWQVPSAMQRVETRPPCQARGRLR

SEQ ID NO: 12136 - protein, 733 aa, Artificial Sequence
  Description of Artificial Sequence: Synthetic coding sequence
MEASWRQVAGGRGRSRGRATAAPSGNGVHLRGAGGGREKGSVGAVPSGTSPGGVATTAAAGSRHSPAGSQALQTTAASELMSQKKFEEIKKANQAAARKLVEEQFSSSSEEGDEDFEGKQGKILANTFITYTTQTDGDTRELERTKQYVNEAFQAGAMTCLICIASVKRNQAVWSCSGCFCIFHMPCIQKWAKDSQFLVSSVTDDDFGKKDCPWPCPKCRFEYKRSETPSRYYCYCGKVEDPPLDPWLVPHSCGQVCEREFKPPCGHKCLLLCHPGPCPPCPKMVTTTCYCKKAKPIPRRCSAKEWSCQLPCGQKLLCGQHKCENPCHAGSCQPCPRVSRQKCVCGKKVAERSCASPLWHCDQVCGKTLPCGNHTCEQVCHVGACGECPRSGKRFCPCQKSKFSLPCTEDVPTCGDSCDKVLECGIHRCSQRCHRGPCETCRQEVEKHCRCGKHTKRMPCHKPYLCETKCVKMRDCQKHQCRRKCCPGNCPPCDQNCGRTLGCRNHKCPSVCHRGSCYPCPETVDVKCNCGNTKVTVPCGRERTTRPPKCKEQCSRPPTCHHTSQEKHRCHFGSCPPCHQPCQKVLEKCGHLCPAPCHDQALIKQTGRHQPTGPWEQPSEPAFIQTALPCPPCQVPIPMECLGKHEVSPLPCHAVGPYSCKRVCGRILDCQNHTCMKECHKVTKTDGCTGKNKIGKLKLCDLSMILQQESSKSESTVPDLLTPSPMCSSTHVI

SEQ ID NO: 12137 - protein, 911 aa, Artificial Sequence
  Description of Artificial Sequence: Synthetic coding sequence
MEASWRQVAGGRGRSRGRATAAPSGNGVHLRGAGGGREKGSVGAVPSGTSPGGVATTAAAGSRHSPAGSQALQTTAASELMSQKKFEEIKKANQAAARKLVEEQFSSSSEEGDEDFEGKQGKILANTFITYTTQTDGDTRELERTKQYVNEAFQAGAMTCLICIASVKRNQAVWSCSGCFCIFHMPCIQKWAKDSQFLVSSVTDDDFGKKDCPWPCPKCRFEYKRSETPSRYYCYCGKVEDPPLDPWLVPHSCGQVCEREFKPPCGHKCLLLCHPGPCPPCPKMVTTTCYCKKAKPIPRRCSAKEWSCQLPCGQKLLCGQHKCENPCHAGSCQPCPRVSRQKCVCGKKVAERSCASPLWHCDQVCGKTLPCGNHTCEQVCHVGACGECPRSGKRFCPCQKSKFSLPCTEDVPTCGDSCDKVLECGIHRCSQRCHRGPCETCRQEVEKHCRCGKHTKRMPCHKPYLCETKCVKMRDCQKHQCRRKCCPGNCPPCDQNCGRTLGCRNHKCPSVCHRGSCYPCPETVDVKCNCGNTKVTVPCGRERTTRPPKCKEQCSRPPTCHHTSQEKHRCHFGSCPPCHQPCQKVLEKCGHLCPAPCHDQALIKQTGRHQPTGPWEQPSEPAFIQTALPCPPCQVPIPMECLGKHEVSPLPCHAVGPYSCKRVCGRILDCQNHTCMKECHKVTKTDGCTGKNKAGPECLHCEEGCSKSRPLGCLHPCILRCHPGECPPCVQMLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQAELEAFENRLKGRRKKNRKRDEVAVELSLWQKHKYYLISVCGVVVVVFAWYITHDVN

SEQ ID NO: 12138 - protein, 911 aa, Artificial Sequence; identical to SEQ ID NO: 12137
  Description of Artificial Sequence: Synthetic coding sequence

SEQ ID NO: 12139 - protein, 1736 aa, Artificial Sequence
  Description of Artificial Sequence: Synthetic coding sequence
MTGCPASSRRRGFGLFFFLRLHRLLLLFLVLRGTLANKLNVPQVLLPFGREPGRVPFLLEAQRGCYTWHSTHHDAVTVEPLYENGTLCSQKAVLIAESTQPIRLSSIILAREIVTDHELRCDVKVDVINSIEIVSRARELYVDDSPLELMVRALDAEGNTFSSLAGMMFEWSIAQDNESAREELSSKIRILKYSEAEYAPPIYIAEMEKEEKQGDVILVSGIRTGAAVVKVRIHEPFYKKVAAALIRLLVLENIFLIPSHDIYLLVGTYIKYQVAKMVQGRVTEVKFPLEHYILELQDHRVALNGSHSEKVAILDDKTAMVTASQLGQTNLVFVHKNVHMRSVSGLPNCTIYVVEPGFLGFTVQPGNRWSLEVGQVYVITVDVFDKSSTKVYISDNLRITYDFPKEYFEEQLTTVNGSYHIVKALKDGVVVINASLTSIIYQNKDIQPIKFLIKHQQEVKIYFPIMLTPKFLAFPHHPMGMLYRYKVQVEGGSGNFTWTSSNETVVIVTTKGVVTAGQVRGNSTVLARDVQNPFRYGEIKIHVLKLNKMELLPFHADVEIGQIIEIPIAMYHINKETKEAMAFTDCSHLSLDLNMDKQGVFTLLKEGIQRPGPMHCSSTHIAAKSLGHTLVTVSVNECDKYLESSATFAAYEPLKALNPVEVALVTWQSVKEMVFEGGPRPWILEPSRFFLELNAEKTEKIGIAQVWLPSKRKQNQYIYRIQCLDLGEQVLTFRIGNHPGVLNPSPAVEVLQVRFICAHPASMSVTPVYKVPAGAQPCPLPQHNKWLIPVSRLRDTVLELAVFDQHRRKFDNFSSLMLEWKSSNETLAHFEDYKSVEMVAKDDGSGQTRLHGHQILKVHQIKGTVLIGVNFVGYSEKKSPKEISNLPRSVDVELLLVDDVTVVPENATIYNHPDVKETFSLVEGSGYFLVNSSEQGVVTITYMEAESSVELVPLHPGFFTLEVYDLCLAFLGPATAHLRVSDIQELELDLIDKVEIDKTVLVTVRVLGSSKRPFQNKYFRNMELKLQLASAIVTLTPMEQQDEYSENYILRATTIGQTTLVAIAKDKMGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKDHCEDSAILKRFTGSYQILLLTLFAVLASTASIFLAYNAFLNKIQTVPVVYVPTLGTPQPGFFNSTSSPPHFMSLQPPLAQSRLQHWLWSIRH

SEQ ID NO: 12140 - protein, 669 aa, Artificial Sequence
  Description of Artificial Sequence: Synthetic coding sequence
MGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKDHCEDSAILKRFTGSYQILLLTLFAVLASTASIFLAYNAFLNKIQTVPVVYVPTLGTPQPGFFNSTSSPPHFMSLQPPLAQSRLQHWLWSIRH

SEQ ID NO: 12141 - protein, 1888 aa, Artificial Sequence
  Description of Artificial Sequence: Synthetic coding sequence
MTGCPASSRRRGFGLFFFLRLHRLLLLFLVLRGTLANKLNVPQVLLPFGREPGRVPFLLEAQRGCYTWHSTHHDAVTVEPLYENGTLCSQKAVLIAESTQPIRLSSIILAREIVTDHELRCDVKVDVINSIEIVSRARELYVDDSPLELMVRALDAEGNTFSSLAGMMFEWSIAQDNESAREELSSKIRILKYSEAEYAPPIYIAEMEKEEKQGDVILVSGIRTGAAVVKVRIHEPFYKKVAAALIRLLVLENIFLIPSHDIYLLVGTYIKYQVAKMVQGRVTEVKFPLEHYILELQDHRVALNGSHSEKVAILDDKTAMVTASQLGQTNLVFVHKNVHMRSVSGLPNCTIYVVEPGFLGFTVQPGNRWSLEVGQVYVITVDVFDKSSTKVYISDNLRITYDFPKEYFEEQLTTVNGSYHIVKALKDGVVVINASLTSIIYQNKDIQPIKFLIKHQQEVKIYFPIMLTPKFLAFPHHPMGMLYRYKVQVEGGSGNFTWTSSNETVVIVTTKGVVTAGQVRGNSTVLARDVQNPFRYGEIKIHVLKLNKMELLPFHADVEIGQIIEIPIAMYHINKETKEAMAFTDCSHLSLDLNMDKQGVFTLLKEGIQRPGPMHCSSTHIAAKSLGHTLVTVSVNECDKYLESSATFAAYEPLKALNPVEVALVTWQSVKEMVFEGGPRPWILEPSRFFLELNAEKTEKIGIAQVWLPSKRKQNQYIYRIQCLDLGEQVLTFRIGNHPGVLNPSPAVEVLQVRFICAHPASMSVTPVYKVPAGAQPCPLPQHNKWLIPVSRLRDTVLELAVFDQHRRKFDNFSSLMLEWKSSNETLAHFEDYKSVEMVAKDDGSGQTRLHGHQILKVHQIKGTVLIGVNFVGYSEKKSPKEISNLPRSVDVELLLVDDVTVVPENATIYNHPDVKETFSLVEGSGYFLVNSSEQGVVTITYMEAESSVELVPLHPGFFTLEVYDLCLAFLGPATAHLRVSDIQELELDLIDKVEIDKTVLVTVRVLGSSKRPFQNKYFRNMELKLQLASAIVTLTPMEQQDEYSENYILRATTIGQTTLVAIAKDKMGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKGVYVCIIKVRPQSEELLQALSVADTSVYGWATLVSERSKNGMQRILIPFIPAFYINQSELVLSHKQDIGEIRVLGVDRVLRKLEVISSSPVLVVAGHSHSPLTPGLAIYSVRVVNFTSFQQMASPVFINISCVLTSQSEAVVVRAMKDKLGADHCEDSAILKRFTGSYQILLLTLFAVLASTASIFLAYNAFLNKIQTVPVVYVPTLGTPQPGFFNSTSSPPHFMSLQPPLAQSRLQHWLWSIRH

SEQ ID NO: 12142 - protein, 212 aa, Artificial Sequence
  Description of Artificial Sequence: Synthetic coding sequence
MASLFSGRILIRNNSDQDELDTEAEVSRRLENRLVLLFFGAGACPQCQAFVPILKDFFVRLTDEFYVLRAAQLALVYVSQDSTEEQQDLFLKDMPKKWLFLPFEDDLRRDLGRQFSVERLPAVVVLKPDGDVLTRDGADEIQRLGTACFANWQEAAEVLDRNFQLPEDLEDQEPRSLTECLRRHKYRVEKAARGGRDPGGGGGEEGGAGGLF

SEQ ID NO: 12143 - protein, 140 aa, Artificial Sequence
  Description of Artificial Sequence: Synthetic coding sequence
MLPDCLSAEGELRCRRLLAGATARLRARPASAAVLVPLCSVRGVPALLYTLRSSRLTGRHKGDVSFPGGKCDPADQDVVHTALRETREELGLAVPEEHVWGLLRPVYDPQKATVVPVLAGVGPLDPQSLRPNSEEVSWGI

SEQ ID NO: 12144 - protein, 236 aa, Artificial Sequence
  Description of Artificial Sequence: Synthetic coding sequence
MLPDCLSAEGELRCRRLLAGATARLRARPASAAVLVPLCSVRGVPALLYTLRSSRLTGRHKGDVSFPGGKCDPADQDVVHTALRETREELGLAVPEEHVWGLLRPVYDPQKATVVPVLAGVGPLDPQSLRPNSEEVDEVFALPLAHLLQTQNQGYTHFCRGGHFRYTLPVFLHGPHRVWGLTAVITEFALQLLAPGTYQPRLAGLTCSGAEGLARPKQPLASPCQASSTPGLNKGL

SEQ ID NO: 12145 - protein, 350 aa, Artificial Sequence
  Description of Artificial Sequence: Synthetic coding sequence
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 12146 - protein, 300 aa, Artificial Sequence
  Description of Artificial Sequence: Synthetic coding sequence
MSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 12147 - protein, 206 aa, Artificial Sequence
  Description of Artificial Sequence: Synthetic coding sequence
MSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKL

SEQ ID NO: 12148 - protein, 262 aa, Artificial Sequence
  Description of Artificial Sequence: Synthetic coding sequence
MAPALLLIPAALASFILAFGTGVEFVRFTSLRPLLGGIPESGGPDARQGWLAALQDRSILAPLAWDLGLLLLFVGQHSLMAAERVKAWTSRYFGVLQRSLYVACTALALQLVMRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 12149 - protein, 203 aa, Artificial Sequence
  Description of Artificial Sequence: Synthetic coding sequence
MAPALLLIPAALASFILAFGTGVEFVRFTSLRPLLGGIPESGGPDARQGWLAALQDRSILAPLAWDLGLLLLFVGQHSLMAAERVKAWTSRYFGVLQRSLYVACTALALQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 12150 - protein, 262 aa, Artificial Sequence; identical to SEQ ID NO: 12148
  Description of Artificial Sequence: Synthetic coding sequence

SEQ ID NO: 12151 - protein, 203 aa, Artificial Sequence; identical to SEQ ID NO: 12149
  Description of Artificial Sequence: Synthetic coding sequence

SEQ ID NO: 12152 - protein, 262 aa, Artificial Sequence; identical to SEQ ID NO: 12148
  Description of Artificial Sequence: Synthetic coding sequence

SEQ ID NO: 12153 - protein, 262 aa, Artificial Sequence
  Description of Artificial Sequence: Synthetic coding sequence
  MOD_RES (1)..(1): Any amino acid
XESGREATGEGDLSSKLGTQGLEFWRGGRVRTEGAEKGGDRSILNARQGWLAALQDRSILAPLAWDLGLLLLFVGQHSLMAAERVKAWTSRYFGVLQRSLYVACTALALQLVMRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 12154 - protein, 262 aa, Artificial Sequence; identical to SEQ ID NO: 12148
  Description of Artificial Sequence: Synthetic coding sequence

SEQ ID NO: 12155 - protein, 203 aa, Artificial Sequence; identical to SEQ ID NO: 12149
  Description of Artificial Sequence: Synthetic coding sequence

SEQ ID NO: 12156 - protein, 262 aa, Artificial Sequence; identical to SEQ ID NO: 12148
  Description of Artificial Sequence: Synthetic coding sequence

SEQ ID NO: 12157 - protein, 262 aa, Artificial Sequence; identical to SEQ ID NO: 12148
  Description of Artificial Sequence: Synthetic coding sequence

SEQ ID NO: 12158 - protein, 262 aa, Artificial Sequence; identical to SEQ ID NO: 12153
  Description of Artificial Sequence: Synthetic coding sequence
  MOD_RES (1)..(1): Any amino acid

SEQ ID NO: 12159 - protein, 262 aa, Artificial Sequence; identical to SEQ ID NO: 12148
  Description of Artificial Sequence: Synthetic coding sequence

SEQ ID NO: 12160 - protein, 262 aa, Artificial Sequence; identical to SEQ ID NO: 12153
  Description of Artificial Sequence: Synthetic coding sequence
  MOD_RES (1)..(1): Any amino acid

SEQ ID NO: 12161 - protein, 262 aa, Artificial Sequence; identical to SEQ ID NO: 12153
  Description of Artificial Sequence: Synthetic coding sequence
  MOD_RES (1)..(1): Any amino acid

SEQ ID NO: 12162 - protein, 262 aa, Artificial Sequence; identical to SEQ ID NO: 12148
  Description of Artificial Sequence: Synthetic coding sequence

SEQ ID NO: 12163 - protein, 262 aa, Artificial Sequence; identical to SEQ ID NO: 12153
  Description of Artificial Sequence: Synthetic coding sequence
  MOD_RES (1)..(1): Any amino acid

SEQ ID NO: 12164 - protein, 262 aa, Artificial Sequence; identical to SEQ ID NO: 12153
  Description of Artificial Sequence: Synthetic coding sequence
  MOD_RES (1)..(1): Any amino acid

SEQ ID NO: 12165 - protein, 203 aa, Artificial Sequence; identical to SEQ ID NO: 12149
  Description of Artificial Sequence: Synthetic coding sequence

SEQ ID NO: 12166 - protein, 262 aa, Artificial Sequence; identical to SEQ ID NO: 12153
  Description of Artificial Sequence: Synthetic coding sequence
  MOD_RES (1)..(1): Any amino acid

SEQ ID NO: 12167 - protein, 203 aa, Artificial Sequence; identical to SEQ ID NO: 12149
  Description of Artificial Sequence: Synthetic coding sequence

SEQ ID NO: 12168 - protein, 203 aa, Artificial Sequence; identical to SEQ ID NO: 12149
  Description of Artificial Sequence: Synthetic coding sequence

SEQ ID NO: 12169 - protein, 203 aa, Artificial Sequence; identical to SEQ ID NO: 12149
  Description of Artificial Sequence: Synthetic coding sequence

SEQ ID NO: 12170 - protein, 151 aa, Artificial Sequence
  Description of Artificial Sequence: Synthetic coding sequence
MGKRPNLLALQLSDSTLADIIARLQAGQKLSGSSPFSSAFNSLSLDKESGLLMFKGDKKPRVWVVPTQLRRDLIFSVHDIPLGAHQRPEETYKKLRLLGWWPGMQEHVKDYCRSCLFCIPRNLIGSELKVIESPPASVLRGQGVCNRSGTR

SEQ ID NO: 12171 - protein, 1898 aa, Artificial Sequence
  Description of Artificial Sequence: Synthetic coding sequence
MLLSGGDPPAQEWFMVQTKSKPRVQRQRLQVQRIFRVKLNAFQSRPDTPYFWLQLEGPRENMGKAKEYLKGLCSPELWKEVRYPPILHCAFLGAQGLFLDCLCWSTLAYLVPGPPGSLMVGGLTESFIMTQNWLEELVGRLRWGPAPLLTPRGIWEAEVTRAFGALVWIRGDQHAGDLLQLPPAVQELLLSLVRDAAGKEDIIEWLSRFGISDSHSDPEVLICPPQQQKEAPAMVSVGESPGPFVDMGTLQNRGPENSKRLSSLGATGSLITAQSTPQEAANQLVRVGSNNQDGMDSAQEEGTVQATSSQDSTNHTQALLKQRQVQKIEDKLLFQPPVSALGVCPPWKAWTPGPAFGPLWPGAIAATFWRINELHSLHLAWLLSQACFNFPFWQRPLGPIQLKLPGQNPLPLNLEWKQKELAPLPSAESPAGRPDGGLGGEAALQNCPRPEISPKVTSLLVVPGSSDVKDKVSSDLPQIGPPLTSTPQLQAGGEPGDQGSMQLDFKGLEEGPAPVLPTGQGKPVAQGGLTDQSVPGAQTVPETLKVPMAAAVPKAENPSRTQVPSAAPKLPTSRMMLAVHTEPAAPEVPLAPTKPTAQLMATAQKTVVNQPVLVAQVEPTTPKTPQAQKMPVAKTSPAGPKTPKAQAGPAATVSKAPAASKAPAAPKVPVTPRVSRAPKTPAAQKVPTDAGPTLDVARLLSEVQPTSRASVSLLKGQGQAGRQGPQSSGTLALSSKHQFQMEGLLGAWEGAPRQPPRHLQANSTVTSFQRYHEALNTPFELNLSGEPGNQGLRRVVIDGSSVAMVHGLQHFFSCRGIAMAVQFFWNRGHREVTVFVPTWQLKKNRRVRESHFLTKLHSLKMLSITPSQLENGKKITTYDYRFMVKLAEETDGIIVTNEQIHILMNSSKKLMVKDRLLPFTFAGNLFMVPDDPLGRDGPTLDEFLKKPNRLDTDIGNFLKVWKTLPPSSASVTELSDDADSGPLESLPNMEEVREEKEERQDEEQRQGQGTQKAAEEDDLDSSLASVFRVECPSLSEEILRCLSLHDPPDGALDIDLLPGAASPYLGIPWDGKAPCQQVLAHLAQLTIPSNFTALSFFMGFMDSHRDAIPDYEALVGPLHSLLKQKPDWQWDQEHEEAFLALKRALVSALCLMAPNSQLPFRLEVTVSHVALTAILHQEHSGRKHPIAYTSKPLLPDEESQGPQSGGDSPYAVAWALKHFSRCIGDTPVVLDLSYASRTTADPEVREGRRVSKAWLIRWSLLVQDKGKRALELALLQGLLGENRLLTPAASMPRFFQVLPPFSDLSTFVCIHMSGYCFYREDEWCAGFGLYVLSPTSPPVSLSFSCSPYTPTYAHLAAVACGLERFGQSPLPVVFLTHCNWIFSLLWELLPLWRARGFLSSDGAPLPHPSLLSYIISLTSGLSSLPFIYRTSYRGSLFAVTVDTLAKQGAQGGGQWWSLPKDVPAPTVSPHAMGKRPNLLALQLSDSTLADIIARLQAGQKLSGSSPFSSAFNSLSLDKESGLLMFKGDKKPRVWVVPTQLRRDLIFSVHDIPLGAHQRPEETYKKLRLLGWWPGMQEHVKDYCRSCLFCIPRNLIGSELKVIESPWPLRSTAPWSNLQIEVVGPVTISEEGHKHVLIVADPNTRWVEAFPLKPYTHTAVAQVLLQHVFARWGVPVRLEAAQGPQFARHVLVSCGLALGAQVASLSRDLQFPCLTSSGAYWEFKRALKEFIFLHGKKWAASLPLLHLAFRASSTDATPFKVLTGGESRLTEPLWWEMSSANIEGLKMDVFLLQLVGELLELHWRVADKASEKAENRRFKRESQEKEWNVGDQVLLLSLPRNGSSAKWVGPFYIGDRLSLSLYRIWGFPTPEKLGCIYPSSLMKAFAKSGTPLSFKVLEQ

SEQ ID NO: 12172 - protein, 2598 aa, Artificial Sequence
  Description of Artificial Sequence: Synthetic coding sequence
GRPIPPTSSPSLLPSAQLPSSHNPPPVSCQMPLLDSNTSHQIMDTNPDEEFSPNSYLLRACSGPQQASSSGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIAMHLLGLNWQLQPADGHTFNNGIRTGLPGNDDVATMPSGGKVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNKEFKHSNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 12173 - protein, 2774 aa, Artificial Sequence
  Description of Artificial Sequence: Synthetic coding sequence
MDVKDRRHRSLTRGRCGKECRYTSSSLDSEDCRVPTQKSYSSSETLKAYDHDSRMHYGNRVTDLIHRESDEFPRQGTNFTLAELGICEPSPHRSGYCSDMGILHQGYSLSTGSDADSDTEGGMSPEHAIRLWGRGIKSRRSSGLSSRENSALTLTDSDNENKSDDENGRPIPPTSSPSLLPSAQLPSSHNPPPVSCQMPLLDSNTSHQIMDTNPDEEFSPNSYLLRACSGPQQASSSGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIAMHLLGLNWQLQPADGHTFNNGIRTGLPGNDDVATMPSGGKVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIGRQTAGTETDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNKEFKHSNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 12174 - protein, 2773 aa, Artificial Sequence
  Description of Artificial Sequence: Synthetic coding sequence
MDVKDRRHRSLTRGRCGKECRYTSSSLDSEDCRVPTQKSYSSSETLKAYDHDSRMHYGNRVTDLIHRESDEFPRQGTNFTLAELGICEPSPHRSGYCSDMGILHQGYSLSTGSDADSDTEGGMSPEHAIRLWGRGIKSRRSSGLSSRENSALTLTDSDNENKSDDENGRPIPPTSSPSLLPSAQLPSSHNPPPVSCQMPLLDSNTSHQIMDTNPDEEFSPNSYLLRACSGPQQASSSGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIAMHLLGLNWQLQPADGHTFNNGIRTGLPGNDDVATMPSGGKVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIVRETIGGECYGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNKEFHNNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 12175 - protein, 2699 aa, Artificial Sequence
  Description of Artificial Sequence: Synthetic coding sequence
MDVKERRPYCSLTKSRREKERRYTNSSADNEECRVPTQKSYSSSETLKAFDHDSSRLLYGNRVKDLVHREADEFTRQGQNFTLRQLGVCEPATRRGLAFCAEMGLPHRGYSISAGSDADTENEAVMSPEHAMRLWGRGVKSGRSSCLSSRSNSALTLTDTEHENKSDSENEQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAILLSYFIAMHLFGLNWQLQQTENDTFENGKVNSDTMPTNTVSLPSGDNGKLGGFTQENNTIDSGELDIGRRAIQEIPPGIFWRSQLFIDQPQFLKFNISLQKDALIGVYGRKGLPPSHTQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACNSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCKDGKCECSQGWNGEHCTIEGCPGLCNSNGRCTLDQNGWHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMKKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKSMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 12176 - protein, 2699 aa, Artificial Sequence; identical to SEQ ID NO: 12175
  Description of Artificial Sequence: Synthetic coding sequence

SEQ ID NO: 12177 - protein, 170 aa, Artificial Sequence
  Description of Artificial Sequence: Synthetic coding sequence
MDVKERRPYCSLTKSRREKERRYTNSSADNEECRVPTQKSYSSSETLKAFDHDSSRLLYGNRVKDLVHREADEFTRQGQNFTLRQLGVCEPATRRGLAFCAEMGLPHRGYSISAGSDADTENEAVMSPEHAMRLWGRGVKSGRSSCLSSRSNSALTLTDTEHENKSDSEN

SEQ ID NO: 12178 - protein, 326 aa, Artificial Sequence
  Description of Artificial Sequence: Synthetic coding sequence
MCPLTLQVTGLMNVSEPNSSFAFVNEFILQGFTCEWTIQIFLFSLFTTTYALTITGNGAIAFVLWCDWRLHTPMYMFLGNFSFLEIWYVSSTVPKMLVNFLSEKKNISFAGCFLQFYFFFSLGTSECLLLTVMAFDQYLAICRPLLYPNIMTGHLCAKLVILCWVCGFLWFLIPIVLISQMPFCGPNIIDHVVCDPGPRFALDCVSAPRIQLFCYTLSSLVIFGNFLFIIGSYTLVLKAVLGMPSSTGRHKAFSTCGSHLAVVSLCYSSLMVMYVSPGLGHSTGMQKIETLFYAMVTPLFNPLIYSLQNKEIKAALRKVLGSSNII

SEQ ID NO: 12179 - protein, 319 aa, Artificial Sequence
  Description of Artificial Sequence: Synthetic coding sequence
MEPGNDTQISEFLLLGFSQEPGLQPFLFGLFLSMYLVTVLGNLLIILATISDSHLHTPMYFFLSNLSFADICVTSTTIPKMLMNIQTQNKVITYIACLMQMYFFILFAGFENFLLSVMAYDRFVAICHPLHYMVIMNPHLCGLLVLASWTMSALYSLLQILMVVRLSFCTALEIPHFFCELNQVIQLACSDSFLNHMVIYFTVALLGGGPLTGILYSYSKIISSIHAISSAQGKYKAFSTCASHLSVVSLFYGAILGVYLSSAATRNSHSSATASVMYTVVTPMLNPFIYSLRNKDIKRALGIHLLWGTMKGQFFKKCP

SEQ ID NO: 12180 - protein, 309 aa, Artificial Sequence
  Description of Artificial Sequence: Synthetic coding sequence
MRENNQSSTLEFILLGVTGQQEQEDFFYILFLFIYPITLIGNLLIVLAICSDVRLHNPMYFLLANLSLVDIFFSSVTIPKMLANHLLGSKSISFGGCLTQMYFMIALGNTDSYILAAMAYDRAVAISRPLHYTTIMSPRSCIWLIAGSWVIGNANALPHTLLTASLSFCGNQEVANFYCDITPLLKLSCSDIHFHVKMMYLGVGIFSVPLLCIIVSYIRVFSTVFQVPSTKGVLKAFSTCGSHLTVVSLYYGTVMGTYFRPLTNYSLKDAVITVMYTAVTPMLNPFIYSLRNRDMKAALRKLFNKRISS

SEQ ID NO: 12181 - protein, 309 aa, Artificial Sequence
  Description of Artificial Sequence: Synthetic coding sequence
MKKENQSFNLDFILLGVTSQQEQNNVFFVIFLCIYPITLTGNLLIILAICADIRLHNPMYFLLANLSLVDIIFSSVTIPKVLANHLLGSKFISFGGCLMQMYFMIALAKADSYTLAAMAYDRAVAISCPLHYTTIMSPRSCILLIAGSWVIGNTSALPHTLLTASLSFCGNQEVANFYCDIMPLLKLSCSDVHFNVKMMYLGVGVFSLPLLCIIVSYVQVFSTVFQVPSTKSLFKAFCTCGSHLTVVFLYYGTTMGMYFRPLTSYSPKDAVITVMYVAVTPALNPFIYSLRNWDMKAALQKLFSKRISS

SEQ ID NO: 12182 - protein, 318 aa, Artificial Sequence
  Description of Artificial Sequence: Synthetic coding sequence
MMSFAPNASHSPVFLLLGFSRANISYTLLFFLFLAIYLTTILGNVTLVLLISWDSRLHSPMYYLLRGLSVIDMGLSTVTLPQLLAHLVSHYPTIPAARCLAQFFFFYAFGVTDTLVIAVMALDRYVAICDPLHYALVMNHQRCACLLALSWVVSILHTMLRVGLVLPLCWTGDAGGNVNLPHFFCDHRPLLRASCSDIHSNELAIFFEGGFLMLGPCALIVLSYVRIGAAILRLPSAAGRRRAVSTCGSHLTMVGFLYGTIICVYFQPPFQNSQYQDMVASVMYTAITPLANPFVYSLHNKDVKGALCRLLEWVKVDP

SEQ ID NO: 12183 - protein, 314 aa, Artificial Sequence
  Description of Artificial Sequence: Synthetic coding sequence
MEKRNLTVVREFVLLGLPSSAEQQHLLSVLFLCMYLATTLGNMLIIATIGFDSHLHSPMYFFLSNLAFVDICFTSTTVPQMVVNILTGTKTISFAGCLTQLFFFVSFVNMDSLLLCVMAYDRYVAICHPLHYTARMNLCLCVQLVAGLWLVTYLHALLHTVLIAQLSFCASNIIHHFFCDLNPLLQLSCSDVSFNVMIIFAVGGLLALTPLVCILVSYGLIFSTVLKITSTQGKQRAVSTCSCHLSVVVLFYGTAIAVYFSPSSPHMPESDTLSTIMYSMVAPMLNPFIYTLRNRDMKRGLQKMLLKCTVFQQQ

SEQ ID NO: 12184 - protein, 314 aa, Artificial Sequence
  Description of Artificial Sequence: Synthetic coding sequence
MMGQNQTSISDFLLLGLPIQPEQQNLCYALFLAMYLTTLLGNLLIIVLIRLDSHLHTPMYLFLSNLSFSDLCFSSVTIPKLLQNMQNQDPSIPYADCLTQMYFFLLFGDLESFLLVAMAYDRYVAICFPLHYTAIMSPMLCLALVALSWVLTTFHAMLHTLLMARLCFCADNVIPHFFCDMSALLKLAFSDTRVNEWVIFIMGGLILVIPFLLILGSYARIVSSILKVPSSKGICKAFSTCGSHLSVVSLFYGTVIGLYLCSSANSSTLKDTVMAMMYTVVTPMLNPFIYSLRNRDMKGALSRVIHQKKTFFSL

SEQ ID NO: 12185 - protein, 323 aa, Artificial Sequence
  Description of Artificial Sequence: Synthetic coding sequence
MMGQNQTSISDFLLLGLPIQPEQQNLCYALFLAMYLTTLLGNLLIIVLIRLDSHLHTPVYLFLSNLSFSDLCFSSVTMPKLLQNMQNQDPSIPYADCLTQMYFFLYFSDLESFLLVAMAYDRYVAICFPMHYTAICFLLHYTAIMSPMLCLSVVALSWVLTTFHAMLHTLLMARLCFCADNVIPHFFCDMSALLKLACSDTRVNEWVIFIMGGLILVIPFLLILGSYARIVSSILKVPSSKGICKAFSTCGSHLSVVSLFYGTVIGLYLCPSANSSTLKDTVMAMMYTVVTPMLTPFIYSLRNRDMKGALERVICKRKNPFLL

SEQ ID NO: 12186 - protein, 313 aa, Artificial Sequence
  Description of Artificial Sequence: Synthetic coding sequence
MEGKNLTSISECFLLGFSEQLEEQKPLFGSFLFMYLVTVAGNLLIILVIITDTQLHTPMYFFLANLSLADACFVSTTVPKMLANIQIQSQAISYSGCLLQLYFFMLFVMLEAFLLAVMAYDCYVAICHPLHYILIMSPGLCIFLVSASWIMNALHSLLHTLLMNSLSFCANHEIPHFFCDINPLLSLSCTDPFTNELVIFITGGLTGLICVLCLIISYTNVFSTILKIPSAQGKRKAFSTCSSHLSVVSLFFGTSFCVDFSSPSTHSAQKDTVASVMYTVVTPMLNPFIYSLRNQEIKSSLRKLIWVRKIHSP

SEQ ID NO: 12187 - protein, 355 aa, Artificial Sequence
  Description of Artificial Sequence: Synthetic coding sequence
MEPEKQTEISEFFLQGLSEKPEHQTLLFTMFLSTYLVTIIGNALIILAIITDSHLHTPMYFFLFNLSLVDTLLSSTTVPKMLANIQAQSRAIPFVGCLTQMYAFHLFGTMDSFLLAVMAIDRFVAIVHPQRYLVLMCSPVCGLLLGASWMITNLQSLIHTCLMAQLTFCAGSEISHFFCDLMPLLKLSGSDTHTNELVIFAFGIVVGTSPFSCILLSYIRIFWTVFKIPSTRGKWKAFSTCGLHLTVVSLSYGTIFAVYLQPTSPSSSQKDKAAALMCGVFIPMLNPFIYSIRNKDMKAALGKLIGKVAVPCPRPEQLLDVYHVPGSLLAARDTEMHPIPYPGGVQSLAGNRDME

SEQ ID NO: 12188 - protein, 322 aa, Artificial Sequence
  Description of Artificial Sequence: Synthetic coding sequence
MSPENQSSVSEFLLLGLPIRPEQQAVFFALFLGMYLTTVLGNLLIMLLIQLDSHLHTPMYFFLSHLALTDISFSSVTVPKMLMNMQTQHLAVFYKGCISQTYFFIFFADLDSFLITSMAYDRYVAICHPLHYATIMTQSQCVMLVAGSWVIACACALLHTLLLAQLSFCADHIIPHYFCDLGALLKLSCSDTSLNQLAIFTAALTAIMLPFLCILVSYGHIGVTILQIPSTKGICKALSTCGSHLSVVTIYYRTIIGLYFLPPSSNTNDKNIIASVIYTAVTPMLNPFIYSLRNKDIKGALRKLLSRSGAVAHACNLNTLGG

SEQ ID NO: 12189 - protein, 313 aa, Artificial Sequence
  Description of Artificial Sequence: Synthetic coding sequence
MSPENQSSVSEFLLLGLPIRPEQQAVFFTLFLGMYLTTVLGNLLIMLLIQLDSHLHTPMYFFLSHLALTDISFSSVTVPKMLMDMRTKYKSILYEECISQMYFFIFFTDLDSFLITSMAYDRYVAICHPLHYTVIMREELCVFLVAVSWILSCASSLSHTLLLTRLSFCAANTIPHVFCDLAALLKLSCSDIFLNELVMFTVGVVVITLPFMCILVSYGYIGATILRVPSTKGIHKALSTCGSHLSVVSLYYGSIFGQYLFPTVSSSIDKDVIVALMYTVVTPMLNPFIYSLRNRDMKEALGKLFSRATFFSW

SEQ ID NO: 12190 - protein, 313 aa, Artificial Sequence
  Description of Artificial Sequence: Synthetic coding sequence
MSPENQSSVSEFLLLGLPIRPEQQAVFFTLFLGMYLTTVLGNLLIMLLIQLDSHLHTPMYFFLSHLALTDISFSSVTVPKMLMDMRTKYKSILYEECISQMYFFIFFTDLDSFLITSMAYDRYVAICHPLHYTVIMREELCVFLVAVSWILSCASSLSHTLLLTRLMKRENQSSVSEFLLLDLPIWPEQQAVFFTLFLGMYLITVLGNLLIILLIRLDSHLHTPMFFFLSHLALTDISLSSVTVPKMLLSMQTQDQSILYAGCVTQMYFFIFFTDLDNFLLTSMAYDRYVAICHPLRYTTIMKEGLCNLLVTV

SEQ ID NO: 12191 - protein, 313 aa, Artificial Sequence
  Description of Artificial Sequence: Synthetic coding sequence
MKRENQSSVSEFLLLDLPIWPEQQAVFFTLFLGMYLITVLGNLLIILLIRLDSHLHTPMFFFLSHLALTDISLSSVTVPKMLLSMQTQDQSILYAGCVTQMYFFIFFTDLDNFLLTSMAYDRYVAICHPLRYTTIMKEGLCNLLVTVSWILSCTNALSHTLLLAQLSFCADNTIPHFFCDLVALLKLSCSDISLNELVIFTVGQAVITLPLICILISYGHIGVTILKAPSTKGIFKALSTCGSHLSVVSLYYGTIIGLYFLPSSSASSDKDVIASVMYTVITPLLNPFIYSLRNRDIKGALERLFNRATVLSQ

SEQ ID NO: 12192 - protein, 316 aa, Artificial Sequence
  Description of Artificial Sequence: Synthetic coding sequence
MEAANESSEGISFVLLGLTTSPGQQRPLFVLFLLLYVASLLGNGLIVAAIQASPALHAPMYFLLAHLSFADLCFASVTVPKMLANLLAHDHSISLAGCLTQMYFFFALGVTDSCLLAAMAYDCYVAIRHPLPYATRMSRAMCAALVGMAWLVSHVHSLLYILLMARLSFCASHQVPHFFCDHQPLLRLSCSDTHHIQLLIFTEGAAVVVTPFLLILASYGAIAAAVLQLPSASGRLRAVSTCGSHLAVVSLFYGTVIAVYFQATSRREAEWGRVATVMYTVVTPMLNPIIYSLWNRDVQGALRALLIGRRISASDS

SEQ ID NO: 12193 - protein, 310 aa, Artificial Sequence
  Description of Artificial Sequence: Synthetic coding sequence
MGRNNLTRPSEFILLGLSSRPEDQKPLFAVFLPIYLITVIGNLLIILAIRSDTRLQTPMYFFLSILSFVDICYVTVIIPKMLVNFLSETKTISYSECLTQMYFFLAFGNTDSYLLAAMAIDRYVAICNPFHYITIMSHRCCVLLLVLSFCIPHFHSLLHILLTNQLIFCASNVIHHFFCDDQPVLKLSCSSHFVKEITVMTEGLAVIMTPFSCIIISYLRILITVLKIPSAAGKRKAFSTCGSHLTVVTLFYGSISYLYFQPLSNYTVKDQIATIIYTVLTPMLNPFIYSLRNKDMKQGLAKLMHRMKCQ

SEQ ID NO: 12194 - protein, 360 aa, Artificial Sequence
  Description of Artificial Sequence: Synthetic coding sequence
MERNHNPDNCNVLNFFFADKKNKRRNFGQIVSDVGRICYSVSLSLGEPTTMGRNNLTRPSEFILLGLSSRPEDQKPLFAVFLPIYLITVIGNLLIILAIRSDTRLQTPMYFFLSILSFVDICYVTVIIPKMLVNFLSETKTISYSECLTQMYFFLAFGNTDSYLLAAMAIDRYVAICNPFHYITIMSHRCCVLLLVLSFCIPHFHSLLHILLTNQLIFCASNVIHHFFCDDQPVLKLSCSSHFVKEITVMTEGLAVIMTPFSCIIISYLRILITVLKIPSAAGKRKAFSTCGSHLTVVTLFYGSISYLYFQPLSNYTVKDQIATIIYTVLTPMLNPFIYSLRNKDMKQGLAKLMHRMKCQ

SEQ ID NO: 12195 - protein, 324 aa, Artificial Sequence
  Description of Artificial Sequence: Synthetic coding sequence
MGMSNLTRLSEFILLGLSSRSEDQRPLFALFLIIYLVTLMGNLLIILAIHSDPRLQNPMYFFLSILSFADICYTTVIVPKMLVNFLSEKKTISYAECLAQMYFFLVFGNIDSYLLAAMAINRCVAICNPFHYVTVMNRRCCVLLLAFPITFSYFHSLLHVLLVNRLTFCTSNVIHHFFCDVNPVLKLSCSSTFVNEIVAMTEGLASVMAPFVCIIISYLRILIAVLKIPSAAGKHKAFSTCSSHLTVVILFYGSISYVYLQPLSSYTVKDRIATINYTVLTSVLNPFIYSLRNKDMKRGLQKLINKIKSQMSRFSTKTNKICGP

SEQ ID NO: 12196 - protein, 311 aa, Artificial Sequence
  Description of Artificial Sequence: Synthetic coding sequence
METKNYSSSTSGFILLGLSSNPKLQKPLFAIFLIMYLLTAVGNVLIILAIYSDPRLHTPMYFFLSNLSFMDICFTTVIVPKMLVNFLSETKIISYVGCLIQMYFFMAFGNTDSYLLASMAIDRLVAICNPLHYDVVMKPWHCLLMLLGSCSISHLHSLFRVLLMSRLSFCASHIIKHFFCDTQPVLKLSCSDTSSSQMVVMTETLAVIVTPFLCTIFSYLQIIVTVLRIPSAAGKWKAFSTCGSHLTVVVLFYGSVIYVYFRPLSMYSVMKGRVATVMYTVVTPMLNPFIYSLRNKDMKRGLKKLRHRIYS

SEQ ID NO: 12197 - protein, 311 aa, Artificial Sequence
  Description of Artificial Sequence: Synthetic coding sequence
MEIKNYSSSTSGFILLGLSSNPQLQKPLFAIFLIMYLLAAVGNVLIIPAIYSDPRLHTPMYFFLSNLSFMDICFTTVIVPKMLVNFLSETKVISYVGCLAQMYFFMAFGNTDSYLLASMAIDRLVAICNPLHYDVVMKPRHCLLMLLGSCSISHLHSLFRVLLMSRLSFCASHIIKHFFCDTQPVLKLSCSDTSSSQMVVMTETLAVIVTPFLCIIFSYLRIMVTVLRIPSAAGKWKAFSTCGSHLTAVALFYGSIIYVYFRPLSMYSVVRDRVATVMYTVVTPMLNPFIYSLRNKDMKRGLKKLQDRIYR

SEQ ID NO: 12198 - protein, 347 aa, Artificial Sequence
  Description of Artificial Sequence: Synthetic coding sequence
MSYFYRLKLMKEAVLVKLPFTSLPLLLQTLSRKSRDMEIKNYSSSTSGFILLGLSSNPQLQKPLFAIFLIMYLLAAVGNVLIIPAIYSDPRLHTPMYFFLSNLSFMDICFTTVIVPKMLVNFLSETKVISYVGCLAQMYFFMAFGNTDSYLLASMAIDRLVAICNPLHYDVVMKPRHCLLMLLGSCSISHLHSLFRVLLMSRLSFCASHIIKHFFCDTQPVLKLSCSDTSSSQMVVMTETLAVIVTPFLCIIFSYLRIMVTVLRIPSAAGKWKAFSTCGSHLTAVALFYGSIIYVYFRPLSMYSVVRDRVATVMYTVVTPMLNPFIYSLRNKDMKRGLKKLQDRIYR

SEQ ID NO: 12199 - protein, 309 aa, Artificial Sequence
  Description of Artificial Sequence: Synthetic coding sequence
MERINHTSSVSEFILLGLSSRPEDQKTLFVLFLIVYLVTITGNLLIILAIRFNPHLQTPMYFFLSFLSLTDICFTTSVVPKMLMNFLSEKKTISYAGCLTQMYFLYALGNSDSCLLAVMAFDRYVAVCDPFHYVTTMSHHHCVLLVAFSCSFPHLHSLLHTLLLNRLTFCDSNVIHHFLCDLSPVLKLSCSSIFVNEIVQMTEAPIVLVTRFLCIAFSYIRILTTVLKIPSTSGKRKAFSTCGFYLTVVTLFYGSIFCVYLQPPSTYAVKDHVATIVYTVLSSMLNPFIYSLRNKDLKQGLRKLMSKRS

SEQ ID NO: 12200 - protein, 316 aa, Artificial Sequence
  Description of Artificial Sequence: Synthetic coding sequence
ITPMEPRNQTSASQFILLGLSEKPEQETLLFSLFFCMYLVMVVGNLLIILAISIDSHLHTPMYFFLANLSLVDFCLATNTIPKMLVSLQTGSKAISYPCCLIQMYFFHFFGIVDSVIIAMMAYDRFVAICHPLHYAKIMSLRLCRLLVGALWAFSCFISLTHILLMARLVFCGSHEVPHYFCDLTPILRLSCTDTSVNRIFILIVAGMVIATPFVCILASYARILVAIMKVPSAGGRKKAFSTCSSHLSVVALFYGTTIGVYLCPSSVLTTVKEKASAVMYTAVTPMLNPFIYSLRNRDLKGALRKLVNRKITSSS

SEQ ID NO: 12201 - protein, 313 aa, Artificial Sequence
  Description of Artificial Sequence: Synthetic coding sequence
MEPRNQTSASQFILLGLSEKPEQETLLFSLFFCMYLVMVVGNLLIILAISIDSHLHTPMYFFLANLSLVDFCLATNTIPKMLVSLQTGSKAISYPCCLIQMYFFHFFGIVDSVIIAMMAYDRFVAICHPLHYAKIMSLRLCRLLVGALWAFSCFISLTHILLMARLVFCGSHEVPHYFCDLTPILRLSCTDTSVNRIFILIVAGMVIATPFVCILASYARILVAIMKVPSAGGRKKAFSTCSSHLSVVALFYGTTIGVYLCPSSVLTTVKEKASAVMYTAVTPMLNPFIYSLRNRDLKGALRKLVNRKITSSS

SEQ ID NO: 12202 - protein, 311 aa, Artificial Sequence
  Description of Artificial Sequence: Synthetic coding sequence
MENQSSISEFFLRGISAPPEQQQSLFGIFLCMYLVTLTGNLLIILAIGSDLHLHTPMYFFLANLSFVDMGLTSSTVTKMLVNIQTRHHTISYTGCLTQMYFFLMFGDLDSFFLAAMAYDRYVAICHPLCYSTVMRPQVCALMLALCWVLTNIVALTHTFLMARLSFCVTGEIAHFFCDITPVLKLSCSDTHINEMMVFVLGGTVLIVPFLCIVTSYIHIVPAILRVRTRGGVGKAFSTCSSHLCVVCVFYGTLFSAYLCPPSIASEEKDIAAAAMYTIVTPMLNPFIYSLRNKDMKGALKRLFSHRSIVSS

SEQ ID NO: 12203 - protein, 330 aa, Artificial Sequence
  Description of Artificial Sequence: Synthetic coding sequence
MEGFYLRRSHELQGMGKPGRVNQTTVSDFLLLGLSEWPEEQPLLFGIFLGMYLVTMVGNLLIILAISSDPHLHTPMYFFLANLSLTDACFTSASIPKMLANIHTQSQIISYSGCLAQLYFLLMFGGLDNCLLAVMAYDRYVAICQPLHYSTSMSPQLCALMLGVCWVLTNCPALMHTLLLTRVAFCAQKAIPHFYCDPSALLKLACSDTHVNELMIITMGLLFLTVPLLLIVFSYVRIFWAVFVISSPGGRWKAFSTCGSHLTVVLLFYGSLMGVYLLPPSTYSTERESRAAVLYMVIIPTLNPFIYSLRNRDMKEALGKLFVSGKTFFL

SEQ ID NO: 12204 - protein, 314 aa, Artificial Sequence
  Description of Artificial Sequence: Synthetic coding sequence
MDNSNWTSVSHFVLLGISTHPEEQIPLFLVFSLMYAINISGNLAIITLILSAPRLHIPMYIFLSNLALTDICFTSTTVPKMLQIIFSPTKVISYTGCLAQTYFFICFAVMENFILAVMAYDRYIAICHPFHYTMILTRMLCVKMVVMCHALSHLHAMLHTFLIGQLIFCADNRIPHFFCDLYALMKISCTSTYLNTLMIHTEGAVVISGALAFITASYACIILVVLRIPSAKGRWKTFSTCGSHLTVVAIFYGTLSWVYFRPLSSYSVTKGRIITVVYTVVTPMLNPFIYSLRNGDVKGGFMKWMSRMQTFFFR

SEQ ID NO: 12205 - protein, 325 aa, Artificial Sequence
  Description of Artificial Sequence: Synthetic coding sequence
MKTFSSFLQIGRNMHQGNQTTITEFILLGFFKQDEHQNLLFVLFLGMYLVTVIGNGLIIVAISLDTYLHTPMYLFLANLSFADISSISNSVPKMLVNIQTKSQSISYESCITQMYFSIVFVVIDNLLLGTMAYDHFVAICHPLNYTILMRPRFGILLTVISWFLSNIIALTHTLLLIQLLFCNHNTLPHFFCDLAPLLKLSCSDTLINELVLFIVGLSVIIFPFTLSFFSYVCIIRAVLRVSSTQGKWKAFSTCGSHLTVVLLFYGTIVGVYFFPSSTHPEDTDKIGAVLFTVVTPMINPFIYSLRNKDMKGALRKLINRKISSL

SEQ ID NO: 12206 - protein, 325 aa, Artificial Sequence
  Description of Artificial Sequence: Synthetic coding sequence
MKTLCSFLQISRNMHQENQTTITEFILLGLSNQAEHQNLLFVLFLSMYVVTVVGNGLIIVAISLDIYLHTPMYLFLAYLSFADISSISNSVPKMLVNIQTNSQSISYESCITQMYFSIVFVVTDNLLLGTMAFDHFVAICHPLNYTTFMRARFGTLLTVISWFLSNIIALTHTLLLIQLLFCDHNTLPHFFCDLAPLLKLSCSDTMINELVLFIVGLSVIIFPFVLIFFSYVCIIRAVLGVSSTQGKWKAFSTCGSHLTIALLFYGTTVGVYFFPSSTHPEDTDKIGAVLFTVVTPMMNPFIYSLRNKDMKGALRKLINRKISSL

SEQ ID NO: 12207 - protein, 303 aa, Artificial Sequence
  Description of Artificial Sequence: Synthetic coding sequence
MSFSSLPTEIQSLLFLTFLTIYLVTLMGNCLIILVTLADPMLHSPMYFFLRNLSFLEIGFNLVIVPKMLGTLLAQDTTISFLGCATQMYFFFFFGVAECFLLATMAYDRYVAICSPLHYPVIMNQRTRAKLAAASWFPGFPVATVQTTWLFSFPFCGTNKVNHFFCDSPPVLRLVCADTALFEIYAIVGTILVVMIPCLLILCSYTHIAAAILKIPSAKGKNKAFSTCSSHLLVVSLFYISLSLTYFRPKSNNSPEGKKLLSLSYTVMTPMLNPIIYSLRNNEVKNALSRTVSKALALRNCIP

SEQ ID NO: 12208 - protein, 314 aa, Artificial Sequence
  Description of Artificial Sequence: Synthetic coding sequence
MKRQNQSCVVEFILLGFSNFPELQVQLFGVFLVIYVVTLMGNAIITVIISLNQSLHVPMYLFLLNLSVVEVSFSAVITPEMLVVLSTEKTMISFVGCFAQMYFILLFGGTECFLLGAMAYDRFAAICHPLNYPVIMNRGVFMKLVIFSWISGIMVATVQTTWVFSFPFCGPNEINHLFCETPPVLELVCADTFLFEIYAFTGTILIVMVPFLLILLSYIRVLFAILKMPSTTGRQKAFSTCASHLTSVTLFYGTANMTYLQPKSGYSPETKKLISLAYTLLTPLLNPLIYSLRNSEMKRTLIKLWRRKVILHTF

SEQ ID NO: 12209 - protein, 315 aa, Artificial Sequence
  Description of Artificial Sequence: Synthetic coding sequence
MMWENWTIVSEFVLVSFSALSTELQALLFLLFLTIYLVTLMGNVLIILVTIADSALQSPMYFFLRNLSFLEIGFNLVIVPKMLGTLIIQDTTISFLGCATQMYFFFFFGAAECCLLATMAYDRYVAICDPLHYPVIMGHISCAQLAAASWFSGFSVATVQTTWIFSFPFCGPNRVNHFFCDSPPVIALVCADTSVFELEALTATVLFILFPFLLILGSYVRILSTIFRMPSAEGKHQAFSTCSAHLLVVSLFYSTAILTYFRPQSSASSESKKLLSLSSTVVTPMLNPIIYSSRNKEVKAALKRLIHRTLGSQKL

SEQ ID NO: 12210 - protein, 317 aa, Artificial Sequence
  Description of Artificial Sequence: Synthetic coding sequence
MAIGNWTEISEFILMSFSSLPTEIQSLLFLTFLTIYLVTLKGNSLIILVTLADPMLHSPMYFFLRNLSFLEIGFNLVIVPKMLGTLLAQDTTISFLGCATQMYFFFFFGVAECFLLATMAYDRYVAICSPLHYPVIMNQRTRAKLAAASWFPGFPVATVQTTWLFSFPFCGTNKVNHFFCDSPPVLKLVCADTALFEIYAIVGTILVVMIPCLLILCSYTRIAAAILKIPSAKGKHKAFSTCSSHLLVVSLFYISSSLTYFWPKSNNSPESKKLLSLSYTVVTPMLNPIIYSLRNSEVKNALSRTFHKVLALRNCIP

SEQ ID NO: 12211 - protein, 321 aa, Artificial Sequence
  Description of Artificial Sequence: Synthetic coding sequence
MPILMAIGNWTEISEFILMSFSSLPTEIQSLLFLTFLTIYLVTLKGNSLIILVTLADPMLHSPMYFFLRNLSFLEIGFNLVIVPKMLGTLLAQDTTISFLGCATQMYFFFFFGVAECFLLATMAYDRYVAICSPLHYPVIMNQRTRAKLAAASWFPGFPVATVQTTWLFSFPFCGTNKVNHFFCDSPPVLKLVCADTALFEIYAIVGTILVVMIPCLLILCSYTRIAAAILKIPSAKGKHKAFSTCSSHLLVVSLFYISSSLTYFWPKSNNSPESKKLLSLSYTVVTPMLNPIIYSLRNSEVKNALSRTFHKVLALRNCIP

SEQ ID NO: 12212 - protein, 314 aa, Artificial Sequence
  Description of Artificial Sequence: Synthetic coding sequence
MERQNQSCVVEFILLGFSNYPELQGQLFVAFLVIYLVTLIGNAIIIVIVSLDQSLHVPMYLFLLNLSVVDLSFSAVIMPEMLVVLSTEKTTISFGGCFAQMYFILLFGGAECFLLGAMAYDRFAAICHPLNYQMIMNKGVFMKLIIFSWALGFMLGTVQTSWVSSFPFCGLNEINHISCETPAVLELACADTFLFEIYAFTGTFLIILVPFLLILLSYIRVLFAILKMPSTTGRQKAFSTCAAHLTSVTLFYGTASMTYLQPKSGYSPETKKVMSLSYSLLTPLLNLLIYSLRNSEMKRALMKLWRRRVVLHTI

SEQ ID NO: 12213 - protein, 316 aa, Artificial Sequence
  Description of Artificial Sequence: Synthetic coding sequence
MICENHTRVTEFILLGFTNNPEMQVSLFIFFLAIYTVTLLGNFLIVTVTSVDLALQTPMYFFLQNLSLLEVCFTLVMVPKMLVDLVSPRKIISFVGCGTQMYFFFFFGSSECFLLSMMAYDRFVAICNPLHYSVIMNRSLCLWMAIGSWMSGVPVSMLQTAWMMALPFCGPNAVDHFFCDGPPVLKLVTVDTTMYEMQALASTLLFIMFPFCLILVSYTRIIITILRMSSATGRQKAFSTCSSHLIVVSLFYGTASLTYLRPKSNQSPESKKLVSLSYTVITPMLNPIIYGLRNNEVKGAVKRTITQKVLQKLDVF

SEQ ID NO: 12214 - protein, 339 aa, Artificial Sequence
  Description of Artificial Sequence: Synthetic coding sequence
MEKREINSAFGVKSRYRYLGPLYVIYTYYHIRIILLFTQAPDLDLFPAANVSIMGAIKLSHNLHTPMYFFLCGLSFSETCTTVVVIPRMLVDFLSESKTISLPECATQMFFFLGFASNNCFIMAAMSYDRYTAIHNPLQYHTLMTRKICLQMMMASWMVGFLFSLCIIVTVFNLSLCDLNTIQHYFCDISPVVSLACNYTFYHEMAIFVLSAFVLVGSCILIMISYVFIVFIVIKMPSAKGRSKAFSTCSSHLTVVSIHYGFACFVYLRPKNSNSFDEDMLTAMIYTILMPLLNPIVYSLRNKEMQIALRKTLGSVFGVFPQKTKKEPEHLKKLHSIDK

SEQ ID NO: 12215 - protein, 317 aa, Artificial Sequence
  Description of Artificial Sequence: Synthetic coding sequence
MLRNGSIVTEFILVGFQQSSTSTRALLFALFLALYSLTMAMNGLIIFITSWTDPKLNSPMYFFLGHLSLLDVCFITTTIPQMLIHLVVRDHIVSFVCCMTQMYFVFCVGVAECILLAFMAYDRYVAICYPLNYVPIISQKVCVRLVGTAWFFGLINGIFLEYISFREPFRRDNHIESFFCEAPIVIGLSCGDPQFSLWAIFADAIVVILSPMVLTVTSYVHILATILSKASSSGRGKTFSTCASHLTVVIFLYTSAMFSYMNPHSTHGPDKDKPFSLLYTIITPMCNPIIYSFRNKEIKEAMVRALGRTRLAQPQSV

SEQ ID NO: 12216 - protein, 301 aa, Artificial Sequence
  Description of Artificial Sequence: Synthetic coding sequence
MEFVLLGFSDIPNLHWMLFSIFLLMYLMILMCNGIIILLIKIHPALQTPMYFFLSNFSLLEICYVTIIIPRMLMDIWTQKGNISLFACATQMCFFLMLGGTECLLLTVMAYDRYVAICKPLQYPLVMNHKVCIQLIIASWTITIPVVIGETCQIFLLPFCGTNTINHFFCDIPPILKLACGNIFVNEITVHVVAVVFITVPFLLIVVSYGKIISNILKLSSARGKAKAFSTCSSHLIVVILFFGAGTITYLQPKPHQFQRMGKLISLFYTILIPTLNPIIYTLRNKDIMVALRKLLAKLLT

SEQ ID NO: 12217 - protein, 312 aa, Artificial Sequence
  Description of Artificial Sequence: Synthetic coding sequence
MSANTSMVTEFLLLGFSHLADLQGLLFSVFLTIYLLTVAGNFLIVVLVSTDAALQSPMYFFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIMVSLFYGTALFIYIRPKASYDPATDPLVSLFYAVVTPILNPIIYSLRNTEVKAALKRTIQKTVPMEI

SEQ ID NO: 12218 - protein, 312 aa, Artificial Sequence; identical to SEQ ID NO: 12217
  Description of Artificial Sequence: Synthetic coding sequence

SEQ ID NO: 12219 - protein, 312 aa, Artificial Sequence
  Description of Artificial Sequence: Synthetic coding sequence
MSANTSMVTEFLLLGFSHLADLQGLLFSVFLTIYLLTVAGNFLIVVLVSTDAALQSPMYLFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIQQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKRTIQKTVPMEI

SEQ ID NO: 12220 - protein, 312 aa, Artificial Sequence
  Description of Artificial Sequence: Synthetic coding sequence
MSANTSMVTEFLLLGFSHLADLQGLLFSVFLTIYLLTVAGNFLIVVLVSTDAALQSPMYFFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKRTIQKTVPMEI

SEQ ID NO: 12221 - protein, 312 aa, Artificial Sequence; identical to SEQ ID NO: 12217
  Description of Artificial Sequence: Synthetic coding sequence

SEQ ID NO: 12222 - protein, 312 aa, Artificial Sequence; identical to SEQ ID NO: 12220
  Description of Artificial Sequence: Synthetic coding sequence

SEQ ID NO: 12223 - protein, 312 aa, Artificial Sequence; identical to SEQ ID NO: 12220
  Description of Artificial Sequence: Synthetic coding sequence

SEQ ID NO: 12224 - protein, 312 aa, Artificial Sequence; identical to SEQ ID NO: 12220
  Description of Artificial Sequence: Synthetic coding sequence

SEQ ID NO: 12225 - protein, 295 aa, Artificial Sequence
  Description of Artificial Sequence: Synthetic coding sequence
SVTEFLLLGVTDIQELQPFLFVVFLTIYFISVAGNGAILMIVISDPRLHSPMYFFLGNLSCLDICYSSVTLPKMLQNFLSAHKISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIMVSLFYGTALFIYIRPKASYDPATDPLVSLFYAVVTPILNPIIYSLRNTEVKAALKR

SEQ ID NO: 12226 - protein, 295 aa, Artificial Sequence; identical to SEQ ID NO: 12225
  Description of Artificial Sequence: Synthetic coding sequence

SEQ ID NO: 12227 - protein, 295 aa, Artificial Sequence
  Description of Artificial Sequence: Synthetic coding sequence
SVTEFLLLGVTDIQELQPFLFVVFLTIYFISVAGNGAILMIVISDPRLHSPMYFFLGNLSCLDICYSSVTLPKMLQNFLSAHKISRSGCALQMFFFLFFGATECCLLAAMAYDRYAAICEPLRYPLLLSHRVCLQLAGSAWACGVLVGLGHTPFIFSLPFCGPNTIQQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKR

SEQ ID NO: 12228 - protein, 295 aa, Artificial Sequence
  Description of Artificial Sequence: Synthetic coding sequence
SVTEFLLLGVTDIQELQPFLFVVFLTIYFISVAGNGAILMIVISDPRLHSPMYFFLGNLSCLDICYSSVTLPKMLQNFLSAHKISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKR

SEQ ID NO: 12229 - protein, 304 aa, Artificial Sequence
  Description of Artificial Sequence: Synthetic coding sequence
ERMSANTSMVTEFLLLGFSHLADLQGLLFSVFLTIYLLTVAGNFLIVVLVSTDAALQSPMYFFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKR

SEQ ID NO: 12230 - protein, 295 aa, Artificial Sequence; identical to SEQ ID NO: 12228
  Description of Artificial Sequence: Synthetic coding sequence

SEQ ID NO: 12231 - protein, 295 aa, Artificial Sequence; identical to SEQ ID NO: 12228
  Description of Artificial Sequence: Synthetic coding sequence

SEQ ID NO: 12232 - protein, 312 aa, Artificial Sequence
  Description of Artificial Sequence: Synthetic coding sequence
MEVKNCCMVTEFILLGIPHTEGLEMTLFVLFLPFYACTLLGNVSILVAVMSSARLHTPMYFFLGNLSVFDMGFSSVTCPKMLLYLMGLSRLISYKDCVCQLFFFHFLGSIECFLFTVMAYDRFTAICYPLRYTVIMNPRICVALAVGTWLLGCIHSSILTSLTFTLPYCGPNEVDHFFCDIPALLPLACADTSLAQRVSFTNVGLISLVCFLLILLSYTRITISILSIRTTEGRRRAFSTCSAHLIAILCAYGPIITVYLQPTPNPMLGTVVQILMNLVGPMLNPLIYTLRNKEVKTALKTILHRTGHVPES

SEQ ID NO: 12233 - protein, 310 aa, Artificial Sequence
  Description of Artificial Sequence: Synthetic coding sequence
MGKTKNTSLDAVVTDFILLGLSHPPNLRSLLFLVFFIIYILTQLGNLLILLTMWADPKLCARPMYILLGVLSFLDMWLSSVTVPRLILDFTPSIKAIPFGGCVAQLYFFHFLGSTQCFLYTLMAYDRYLAICQPLHYPVLMNGRLCTVLVAGAWVAGSMHGSIQATLTFRLPYCGPNQVDYFICDIRAVLRLACADTTVNELVTFVDVRVVAASCFMLILLSYANIVHAILKIRTADGRRRAFSTCGSHLIVVTVYYVPCIFIYLRAGSKDPLDGAAAVFYTVVTPLLNPLIYTLRNQEVKSALKRITAG

SEQ ID NO: 12234 - protein, 313 aa, Artificial Sequence
  Description of Artificial Sequence: Synthetic coding sequence
MERINSTLLTAFILTGIPYPLRLRTLFFVFFFLIYILTQLGNLLILITVWADPRLHARPMYIFLGVLSVIDMSISSIIVPRLMMNFTLGVKPIPFGGCVAQLYFYHFLGSTQCFLYTLMAYDRYLAICQPLRYPVLMTAKLSALLVAGAWMAGSIHGALQAILTFRLPYCGPNQVDYFFCDIPAVLRLACADTTVNELVTFVDIGVVVASCFSLILLSYIQIIQAILRIHTADGRRRAFSTCGAHVTVVTVYYVPCAFIYLRPETNSPLDGAAALVPTAITPFLNPLIYTLRNQEVKLALKRMLRSPRTPSEV

SEQ ID NO: 12235 - protein, 311 aa, Artificial Sequence
  Description of Artificial Sequence: Synthetic coding sequence
MSNASLVTAFILTGLPHAPGLDALLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATGTWLSGSLHSAVQTILTFHLPYCGPNQIQHYFCDAPPILKLACADTSANVMVIFVDIGIVASGCFVLIVLSYVSIVCSILRIRTSDGRRRAFQTCASHCIVVLCFFVPCVVIYLRPGSMDAMDGVVAIFYTVLTPLLNPVVYTLRNKEVKKAVLKLRDKVAHPQRK

SEQ ID NO: 12236 - protein, 311 aa, Artificial Sequence
  Description of Artificial Sequence: Synthetic coding sequence
MSNATLLTAFILTGLPHAPGLDAPLFGIFLVVYVLTVLGNLLILLVIRVDSHLHTPMYYFLTNLSFIDMWFSTVTVPKMLMTLVSPSGRTISFHSCVAQLYFFHFLGSTECFLYTVMSYDRYLAISYPLRYTNMMTGRSCALLATGTWLSGSLHSAVQTILTFHLPYCGPNQIQHYFCDAPPILKLACADTSANEMVIFVNIGLVASGCFVLIVLSYVSIVCSILRIRTSEGRHRAFQTCASHCIVVLCFFGPGLFIYLRPGSRDALHGVVAVFYTTLTPLFNPVVYTLRNKEVKKALLKLKNGSVFAQGE

SEQ ID NO: 12237 - protein, 311 aa, Artificial Sequence
  Description of Artificial Sequence: Synthetic coding sequence
MSNASLLTAFILMGLPHAPALDAPLFGVFLVVYVLTVLGNLLILLVIRVDSHLHTTMYYFLTNLSFIDMWFSTVTVPKLLMTLVFPSGRAISFHSCMAQLYFFHFLGGTECFLYRVMSCDRYLAISYPLRYTSMMTGRSCTLLATSTWLSGSLHSAVQAILTFHLPYCGPNWIQHYLCDAPPILKLACADTSAIETVIFVTVGIVASGCFVLIVLSYVSIVCSILRIRTSEGKHRAFQTCASHCIVVLCFFGPGLFIYLRPGSRKAVDGVVAVFYTVLTPLLNPVVYTLRNKEVKKALLKLKDKVAHSQSK

SEQ ID NO: 12238 - protein, 311 aa, Artificial Sequence
  Description of Artificial Sequence: Synthetic coding sequence
MSKTSLVTAFILTGLPHAPGLDAPLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATSTWLSGSLHSAVQTILTFHLPYCGPNQIQHYLCDAPPILKLACADTSANEMVIFVDIGLVASGCFLLIVLSYVSIVCSILRIHTSEGRHRAFQTCASHCIVVLCFFVPCVFIYLRPGSRDVVDGVVAIFYTVLTPLLNPVVYTLRNKEVKKAVLKLRDKVAHSQGE

SEQ ID NO: 12239 - protein, 318 aa, Artificial Sequence
  Description of Artificial Sequence: Synthetic coding sequence
MQRANHSTVTQFILVGFSVFPHLQLMLFLLFLLMYLFTLLGNLLIMATVWSERSLHTPMYLFLCALSVSEILYTVAIIPRMLADLLSTQRSIAFLACASQMFFSFSFGFTHSFLLTVMGYDRYVAICHPLRYNVLMSPRGCACLVGCSWAGGLVMGMVVTSAIFHLAFCGHKEIHHFACHVPPLLKLACGDDVLVVAKGVGLVCITALLGCFLLILLSYAFIVAAILKIPSAEGRNKAFSTCASHLTVVVVHYGFASVIYLKPKSPQSLEGDTLMGITYTVLTPFLSPIIFSLRNKELKVAMKKTFFSKLYPEKNVMM

SEQ ID NO: 12240 - protein, 315 aa, Artificial Sequence
  Description of Artificial Sequence: Synthetic coding sequence
MLGLNHTSMSEFILVGFSAFPHLQLMLFLLFLLMYLFTLLGNLLIMATVWSERSLHTPMYLFLCVLSVSEILYTVAIIPRMLADLLSTQRSIAFLACASQMFFSFSFGFTHSFLLTVMGYDRYVAICHPLRYNVLMSPRGCACLVGCSWAGGSVMGMVVTSAIFQLTFCGSHEIQHFLCHVPPLLKLACGNNVPAVALGVGLVCIMALLGCFLLILLSYAFIVADILKIPSAEGRNKAFSTCASHLIVVIVHYGFASVIYLKPKGPHSQEGDTLMATTYAVLTPFLSPIIFSLRNKELKVAMKRTFLSTLYSSGT

SEQ ID NO: 12241 - protein, 316 aa, Artificial Sequence
  Description of Artificial Sequence: Synthetic coding sequence
MPGQNYRTISEFILSGFSAFPQQLLPVLFLLYLLMFLFTLLGNLLIMATVWIERRLHTPMYLFLCALSISEILFTVAITPRMLADLLFTHRSITFVACAIQMFFSFMFGFTHSFLLMVMGYDHYVTICHPLHYNMLMSPRGCAHLVAWTWAGGSVMGMMVTMMVFHLTFCGSNVIHHFLCHVLSLLKLACGSKTSSVIMGVMLVCVTALIGCLFLIILSFVFIVAAILRIPSAEGRHKTFSTCVSHLTVVVMHYSFASLIYLKPKGLHSMYSDALMATTYTVFTPFLSPIIFSLRNKELKNAINKNFCRRFCPLSS

SEQ ID NO: 12242 - protein, 316 aa, Artificial Sequence
  Description of Artificial Sequence: Synthetic coding sequence
MPSQNYSIISEFNLFGFSAFPQHLLPILFLLYLLMFLFTLLGNLLIMATIWIEHRLHTPMYLFLCTLSVSEILFTVAITPRMLADLLSTHHSITFVACANQMFFSFMFGFTHSFLLLVMGYDRYVAICHPLRYNVLMSPRDCAHLVACTWAGGSVMGMMVTTIVFHLTFCGSNVIHHFFCHVLSLLKLACENKTSSVIMGVMLVCVTALIGCLFLIILSYVFIVAAILRIPSAEGRHKTFSTCVSHLTVVVTHYSFASFIYLKPKGLHSMYSDALMATTYTVFTPFLSPIIFSLRNKELKNAINKNFYRKFCPPSS

SEQ ID NO: 12243 - protein, 315 aa, Artificial Sequence
  Description of Artificial Sequence: Synthetic coding sequence
MQGLNHTSVSEFILVGFSAFPHLQLMLFLLFLLMYLFTLLGNLLIMATVWSERSLHMPMYLFLCALSITEILYTVAIIPRMLADLLSTQRSIAFLACASQMFFSFSFGFTHSFLLTVMGYDRYVAICHPLRYNVLMSLRGCTCRVGCSWAGGLVMGMVVTSAIFHLAFCGHKEIHHFFCHVPPLLKLACGDDVLVVAKGVGLVCITALLGCFLLILLSYAFIVAAILKIPSAEGRNKAFSTCASHLTVVVVHYGFASVIYLKPKGPQSPEGDTLMGITYTVLTPFLSPIIFSLRNKELKVAMKKTCFTKLFPQNC

SEQ ID NO: 12244 - protein, 320 aa, Artificial Sequence
  Description of Artificial Sequence: Synthetic coding sequence
MLLCFRFGNQSMKRENFTLITDFVFQGFSSFHEQQITLFGVFLALYILTLAGNIIIVTIIRMDLHLHTPMYFFLSMLSTSETVYTLVILPRMLSSLVGMSQPISLAGCATQMFFFVTFGITNCFLLTAMGYDRYVAICNPLRYMVIMNKRLRIQLVLGACSIGLIVAITQVTSVFRLPFCARKVPHFFCDIRPVMKLSCIDTTVNEILTLIISVLVLVVPMGLVFISYVLIISTILKIASVEGRKKAFATCASHLTVVIVHYSCASIAYLKPKSENTREHDQLISVTYTVITPLLNPVVYTLRNKEVKDALCRAVGGKFS

SEQ ID NO: 12245 - protein, 329 aa, Artificial Sequence
  Description of Artificial Sequence: Synthetic coding sequence
MPKLNSTFVTEFLFEGFSSFRRQHKLVFFVVFLTLYLLTLSGNVIIMTIIRLDHHLHTPMYFFLCMLSISETCYTVAIIPHMLSGLLNPHQPIATQSCATQLFFYLTFGINNCFLLTVMGYDRYVAICNPLRYSVIMGKRACIQLASGSLGIGLGMAIVQVTSVFGLPFCDAFVISHFFCDVRHLLKLACTDTTVNEIINFVVSVCVLVLPMGLVFISYVLIISTILKIASAEGQKKAFATCASHLTVVIIHYGCASIIYLKPKSQSSLGQDRLISVTYTHHSPTEPCCVQPEEQGGQRCSAQSRGAKNSVSLMKRGCEGFSFAFINMY

SEQ ID NO: 12246 - protein, 309 aa, Artificial Sequence
  Description of Artificial Sequence: Synthetic coding sequence
MKRKNFTEVSEFIFLGFSSFGKHQITLFVVFLTVYILTLVANIIIVTIICIDHHLHTPMYFFLSMLASSETVYTLVIVPRMLLSLIFHNQPISLAGCATQMFFFVILATNNCFLLTAMGYDRYVAICRPLRYTVIMSKGLCAQLVCGSFGIGLTMAVLHVTAMFNLPFCGTVVDHFFCDIYPVMKLSCIDTTINEIINYGVSSFVIFVPIGLIFISYVLVISSILQIASAEGRKKTFATCVSHLTVVIVHCGCASIAYLKPKSESSIEKDLVLSVTYTIITPLLNPVVYSLRNKEVKDALCRVVGRNIS

SEQ ID NO: 12247 - protein, 313 aa, Artificial Sequence
  Description of Artificial Sequence: Synthetic coding sequence
MEQVNKTVVREFVVLGFSSLARLQQLLFVIFLLLYLFTLGTNAIIISTIVLDRALHTPMYFFLAILSCSEICYTFVIVPKMLVDLLSQKKTISFLGCAIQMFSFLFFGSSHSFLLAAMGYDRYMAICNPLRYSVLMGHGVCMGLMAAACACGFTVSLVTTSLVFHLPFHSSNQLHHFFCDISPVLKLASQHSGFSQLVIFMLGVFALVIPLLLILVSYIRIISAILKIPSSVGRYKTFSTCASHLIVVTVHYSCASFIYLRPKTNYTSSQDTLISVSYTILTPLFNPMIYSLRNKEFKSALRRTIGQTFYPLS

SEQ ID NO: 12248 - protein, 312 aa, Artificial Sequence
  Description of Artificial Sequence: Synthetic coding sequence
MERVNETVVREVIFLGFSSLARLQQLLFVIFLLLYLFTLGTNAIIISTIVLDRALHIPMYFFLAILSCSEICYTFIIVPKMLVDLLSQKKTISFLGCAIQMFSFLFLGCSHSFLLAVMGYDRYIAICNPLRYSVLMGHGVCMGLVAAACACGFTVAQIITSLVFHLPFYSSNQLHHFFCDIAPVLKLASHHNHFSQIVIFMLCTLVLAIPLLLILVSYVHILSAILQFPSTLGRCKAFSTCVSHLIIVTVHYGCASFIYLRPQSNYSSSQDALISVSYTIITPLFNPMIYSLRNKEFKSALCKIVRRTISLL

SEQ ID NO: 12249 - protein, 313 aa, Artificial Sequence
  Description of Artificial Sequence: Synthetic coding sequence
MAGENHTTLPEFLLLGFSDLKALQGPLFWVVLLVYLVTLLGNSLIILLTQVSPALHSPMYFFLRQLSVVELFYTTDIVPRTLANLGSPHPQAISFQGCAAQMYVFIVLGISECCLLTAMAYDRYVAICQPLRYSTLLSPRACMAMVGTSWLTGIITATTHASLIFSLPFRSHPIIPHFLCDILPVLRLASAGKHRSEISVMTATIVFIMIPFSLIVTSYIRILGAILAMASTQSRRKVFSTCSSHLLVVSLFFGTASITYIRPQAGSSVTTDRVLSLFYTVITPMLNPIIYTLRNKDVRRALRHLVKRQRPSP

SEQ ID NO: 12250 - protein, 319 aa, Artificial Sequence
  Description of Artificial Sequence: Synthetic coding sequence
MPVGKLVFNQSEPTEFVFRAFTTATEFQVLLFLLFLLLYLMILCGNTAIIWVVCTHSTLRTPMYFFLSNLSFLELCYTTVVVPLMLSNILGAQKPISLAGCGAQMFFFVTLGSTDCFLLAIMAYDRYVAICHPLHYTLIMTRELCTQMLGGALGLALFPSLQLTALIFTLPFCGHHQEINHFLCDVPPVLRLACADIRVHQAVLYVVSILVLTIPFLLICVSYVFITCAILSIRSAEGRRRAFSTCSFHLTVVLLQYGCCSLVYLRPRSSTSEDEDSQIALVYTFVTPLLNPLLYSLRNKDVKGALRSAIIRKAASDAN

SEQ ID NO: 12251 - protein, 335 aa, Artificial Sequence
  Description of Artificial Sequence: Synthetic coding sequence
MPQILIFTYLNMFYFFPPLQILAENLTMVTEFLLLGFSSLGEIQLALFVVFLFLYLVILSGNVTIISVIHLDKSLHTPMYFFLGILSTSETFYTFVILPKMLINLLSVARTISFNCCALQMFFFLGFAITNCLLLGVMGYDRYAAICHPLHYPTLMSWQVCGKLAAACAIGGFLASLTVVNLVFSLPFCSANKVNHYFCDISAVILLACTNTDVNEFVIFICGVLVLVVPFLFICVSYLCILRTILKIPSAEGRRKAFSTCASHLSVVIVHYGCASFIYLRPTANYVSNKDRLVTVTYTIVTPLLNPMVYSLRNKDVQLAIRKVLGKKGSLKLYN

SEQ ID NO: 12252 - protein, 331 aa, Artificial Sequence
  Description of Artificial Sequence: Synthetic coding sequence
MTSRSVCEKMTMTTENPNQTVVSHFFLEGLRYTAKHSSLFFLLFLLIYSITVAGNLLILLTVGSDSHLSLPMYHFLGHLSFLDACLSTVTVPKVMAGLLTLDGKVISFEGCAVQLYCFHFLASTECFLYTVMAYDRYLAICQPLHYPVAMNRRMCAEMAGITWAIGATHAAIHTSLTFRLLYCGPCHIAYFFCDIPPVLKLACTDTTINELVMLASIGIVAAGCLILIVISYIFIVAAVLRIRTAQGRQRAFSPCTAQLTGVLLYYVPPVCIYLQPRSSEAGAGAPAVFYTIVTPMLNPFIYTLRNKEVKHALQRLLCSSFRESTAGSPPP

SEQ ID NO: 12253 - protein, 314 aa, Artificial Sequence
  Description of Artificial Sequence: Synthetic coding sequence
MRGFNKTTVVTQFILVGFSSLGELQLLLFVIFLLLYLTILVANVTIMAVIRFSWTLHTPMYGFLFILSFSESCYTFVIIPQLLVHLLSDTKTISFMACATQLFFFLGFACTNCLLIAVMGYDRYVAICHPLRYTLIINKRLGLELISLSGATGFFIALVATNLICDMRFCGPNRVNHYFCDMAPVIKLACTDTHVKELALFSLSILVIMVPFLLILISYGFIVNTILKIPSAEGKKAFVTCASHLTVVFVHYGCASIIYLRPKSKSASDKDQLVAVTYTVVTPLLNPLVYSLRNKEVKTALKRVLGMPVATKMS

SEQ ID NO: 12254 - protein, 309 aa, Artificial Sequence
  Description of Artificial Sequence: Synthetic coding sequence
MEGINKTAKMQFFFRPFSPDPEVQMLIFVVFLMMYLTSLGGNATIAVIVQINHSLHTPMYFFLANLAVLEIFYTSSITPLALANLLSMGKTPVSITGCGTQMFFFVFLGGADCVLLVVMAYDQFIAICHPLRYRLIMSWSLCVELLVGSLVLGFLLSLPLTILIFHLPFCHNDEIYHFYCDMPAVMRLACADTRVHKTALYIISFIVLSIPLSLISISYVFIVVAILRIRSAEGRQQAYSTCSSHILVVLLQYGCTSFIYLSPSSSYSPEMGRVVSVAYTFITPILNPLIYSLRNKELKDALRKALRKF

SEQ ID NO: 12255 - protein, 305 aa, Artificial Sequence
  Description of Artificial Sequence: Synthetic coding sequence
MEFVFLAYPSCPELHILSFLGVSLVYGLIITGNILIVVSIHTETCLCTSMYYFLGSLSGIEICYTAVVVPHILANTLQSEKTITLLGCATQMAFFIALGSADCFLLAAMAYDRYVAICHPLQYPLLMTLTLCVHLVVASVISGLFLSLQLVAFIFSLPFCQAQGIEHFFCDVPPVMHVVCAQSHIHEQSVLVAAILAIAVPFFLITTSYTFIVAALLKIHSAAGRHRAFSTCSSHLTVVLLQYGCCAFMYLCPSSSYNPKQDRFISLVYTLGTPLLNPLIYALRNSEMKGAVGRVLTRNCLSQNS

SEQ ID NO: 12256 - protein, 326 aa, Artificial Sequence
  Description of Artificial Sequence: Synthetic coding sequence
MVLNVYCCFFQISDIQTMKINQTILKEFILVGFSVYPHVQTFLFVVFFCLYLLTLAGNLIIMGLTWVDRSLHTPMYLFLSALSFSETCYTLTIVPKMLEDLLAKDRSISVTGCSLQMCFFLGLGGTNCIILTLMGYDRFLAICNPLRYPLLMTNIVCGQLVASACTAGFFISLTETALIFRDSFCRPNLVKHFFCHMLAVIRLSCIDSNHTEFIITLISVSGLLGTLLLIILTDVFIISTVLRIPSAEGKQKAFTTCASHLTVVIIHFGFASIVYLKPEASGDDTLIAVPYTVITPFLSPIIFSLRNKDMKNAFRRMMGNTVALKK

SEQ ID NO: 12257 - protein, 313 aa, Artificial Sequence
  Description of Artificial Sequence: Synthetic coding sequence
MGQTNVTSWRDFVFLGFSSSGELQLLLFALFLSLYLVTLTSNVFIIIAIRLDSHLHTPMYLFLSFLSFSETCYTLGIIPRMLSGLAGGDQAISYVGCAAQMFFSASWACTNCFLLAAMGFDRYVAICAPLHYASHMNPTLCAQLVITSFLTGYLFGLGMTLVIFHLSFCSSHEIQHFFCDTPPVLSLACGDTGPSELRIFILSLLVLLVSFFFITISYAYILAAILRIPSAEGQKKAFSTCASHLTVVIIHYGCASFVYLRPKASYSLERDQLIAMTYTVVTPLLNPIVYSLRNRAIQTALRNAFRGRLLGKG

SEQ ID NO: 12258 - protein, 12 aa, Artificial Sequence
  Description of Artificial Sequence: Synthetic coding sequence
VTPQKLSFCSSH

SEQ ID NO: 12259 - protein, 315 aa, Artificial Sequence
  Description of Artificial Sequence: Synthetic coding sequence
MEIVSTGNETITEFVLLGFYDIPELHFLFFIVFTAVYVFIIIGNMLIIVAVVSSQRLHKPMYIFLANLSFLDILYTSAVMPKMLEGFLQEATISVAGCLLQFFIFGSLATAECLLLAVMAYDRYLAICYPLHYPLLMGPRRYMGLVVTTWLSGFVVDGLVVALVAQLRFCGPNHIDQFYCDFMLFVGLACSDPRVAQVTTLILSVFCLTIPFGLILTSYARIVVAVLRVPAGASRRRAFSTCSSHLAVVTTFYGTLMIFYVAPSAVHSQLLSKVFSLLYTVVTPLFNPVIYTMRNKEVHQALRKILCIKQTETLD

SEQ ID NO: 12260 - protein, 315 aa, Artificial Sequence; identical to SEQ ID NO: 12259
  Description of Artificial Sequence: Synthetic coding sequence

SEQ ID NO: 12261 - protein, 315 aa, Artificial Sequence; identical to SEQ ID NO: 12259
  Description of Artificial Sequence: Synthetic coding sequence

SEQ ID NO: 12262 - protein, 315 aa, Artificial Sequence; identical to SEQ ID NO: 12259
  Description of Artificial Sequence: Synthetic coding sequence

SEQ ID NO: 12263 - protein, 315 aa, Artificial Sequence; identical to SEQ ID NO: 12259
  Description of Artificial Sequence: Synthetic coding sequence

SEQ ID NO: 12264 - protein, 315 aa, Artificial Sequence; identical to SEQ ID NO: 12259
  Description of Artificial Sequence: Synthetic coding sequence

SEQ ID NO: 12265 - protein, 315 aa, Artificial Sequence; identical to SEQ ID NO: 12259
  Description of Artificial Sequence: Synthetic coding sequence

SEQ ID NO: 12266 - protein, 315 aa, Artificial Sequence; identical to SEQ ID NO: 12259
  Description of Artificial Sequence: Synthetic coding sequence

SEQ ID NO: 12267 - protein, 315 aa, Artificial Sequence; identical to SEQ ID NO: 12259
  Description of Artificial Sequence: Synthetic coding sequence

SEQ ID NO: 12268 - protein, 315 aa, Artificial Sequence; identical to SEQ ID NO: 12259
  Description of Artificial Sequence: Synthetic coding sequence

SEQ ID NO: 12269 - protein, 315 aa, Artificial Sequence; identical to SEQ ID NO: 12259
  Description of Artificial Sequence: Synthetic coding sequence

SEQ ID NO: 12270 - protein, 315 aa, Artificial Sequence; identical to SEQ ID NO: 12259
  Description of Artificial Sequence: Synthetic coding sequence

SEQ ID NO: 12271 - protein, 315 aa, Artificial Sequence; identical to SEQ ID NO: 12259
  Description of Artificial Sequence: Synthetic coding sequence

SEQ ID NO: 12272 - protein, 315 aa, Artificial Sequence; identical to SEQ ID NO: 12259
  Description of Artificial Sequence: Synthetic coding sequence

SEQ ID NO: 12273 - protein, 315 aa, Artificial Sequence; identical to SEQ ID NO: 12259
  Description of Artificial Sequence: Synthetic coding sequence

SEQ ID NO: 12274 - protein, 315 aa, Artificial Sequence; identical to SEQ ID NO: 12259
  Description of Artificial Sequence: Synthetic coding sequence

SEQ ID NO: 12275 - protein, 315 aa, Artificial Sequence; identical to SEQ ID NO: 12259
  Description of Artificial Sequence: Synthetic coding sequence

SEQ ID NO: 12276 - protein, 315 aa, Artificial Sequence; identical to SEQ ID NO: 12259
  Description of Artificial Sequence: Synthetic coding sequence

SEQ ID NO: 12277 - protein, 315 aa, Artificial Sequence; identical to SEQ ID NO: 12259
  Description of Artificial Sequence: Synthetic coding sequence

SEQ ID NO: 12278 - protein, 315 aa, Artificial Sequence; identical to SEQ ID NO: 12259
  Description of Artificial Sequence: Synthetic coding sequence

SEQ ID NO: 12279 - protein, 315 aa, Artificial Sequence; identical to SEQ ID NO: 12259
  Description of Artificial Sequence: Synthetic coding sequence

SEQ ID NO: 12280 - protein, 345 aa, Artificial Sequence
  Description of Artificial Sequence: Synthetic coding sequence
MHFLSQNDLNINLIPHLCLHRHSVIAGAFTIHRHMKIFNSPSNSSTFTGFILLGFPCPREGQILLFVLFTVVYLLTLMGNGSIICAVHWDQRLHAPMYILLANFSFLEICYVTSTVPSMLANFLSDTKIISFSGCFLQFYFFFSLGSTECFFLAVMAFDRYLAICRPLRYPTIMTRRLCTNLVVNCWVLGFIWFLIPIVNISQMSFCGSRIIDHFLCDPAPLLTLTCKKGPVIELVFSVLSPLPVFMLFLFIVGSYALVVRAVLRVPSAAGRRKAFSTCGSHLAVVSLFYGSVLVMYGSPPSKNEAGKQKTVTLFYSVVTPLLNPVIYSLRNKDMRKALKKFWGT

SEQ ID NO: 12281 - protein, 326 aa, Artificial Sequence
  Description of Artificial Sequence: Synthetic coding sequence
MCPLTLQVTGLMNVSEPNSSFAFVNEFILQGFSCEWTIQIFLFSLFTTTYALTITGNGAIAFVLWCDRRLHTPMYMFLGNFSFLEIWYVSSTVPKMLVNFLSEKKNISFAGCFLQFYFFFSLGTSECLLLTVMAFDQYLAICRPLLYPNIMTGHLYAKLVILCWVCGFLWFLIPIVLISQMPFCGPNIIDHVVCDPGPRFALDCVSAPRIQLFCYTLSSLVIFGNFLFIIGSYTLVLKAMLGMPSSTGRHKAFSTCGSHLAVVSLCYSSLMVMYVSPGLGHSTGMQKIETLFYAMVTPLFNPLIYSLQNKEIKAALRKVLGSSNII

SEQ ID NO: 12282 - protein, 324 aa, Artificial Sequence
  Description of Artificial Sequence: Synthetic coding sequence
MSFFFVDLRPMNRSATHIVTEFILLGFPGCWKIQIFLFSLFLVIYVLTLLGNGAIIYAVRCNPLLHTPMYFLLGNFAFLEIWYVSSTIPNMLVNILSKTKAISFSGCFLQFYFFFSLGTTECLFLAVMAYDRYLAICHPLQYPAIMTVRFCGKLVSFCWLIGFLGYPIPIFYISQLPFCGPNIIDHFLCDMDPLMALSCAPAPITECIFYTQSSLVLFFTSMYILRSYILLLTAVFQVPSAAGRRKAFSTCGSHLVVVSLFYGTVMVMYVSPTYGIPTLLQKILTLVYSVTTPLFNPLIYTLRNKDMKLALRNVLFGMRIRQNS

SEQ ID NO: 12283 - protein, 330 aa, Artificial Sequence
  Description of Artificial Sequence: Synthetic coding sequence
MFFIIHSLVTSVFLTALGPQNRTMHFVTEFVLLGFHGQREMQSCFFSFILVLYLLTLLGNGAIVCAVKLDRRLHTPMYILLGNFAFLEIWYISSTVPNMLVNILSEIKTISFSGCFLQFYFFFSLGTTECFFLSVMAYDRYLAICRPLHYPSIMTGKFCIILVCVCWVGGFLCYPVPIVLISQLPFCGPNIIDHLVCDPGPLFALACISAPSTELICYTFNSMIIFGPFLSILGSYTLVIRAVLCIPSGAGRTKAFSTCGSHLMVVSLFYGTLMVMYVSPTSGNPAGMQKIITLVYTAMTPFLNPLIYSLRNKDMKDALKRVLGLTVSQN

SEQ ID NO: 12284 - protein, 322 aa, Artificial Sequence
  Description of Artificial Sequence: Synthetic coding sequence
MEPQNTSTVTNFQLLGFQNLLEWQALLFVIFLLIYCLTIIGNVVIITVVSQGLRLHSPMYMFLQHLSFLEVWYTSTTVPLLLANLLSWGQAISFSACMAQLYFFVFLGATECFLLAFMAYDRYLAICSPLRYPFLMHRGLCARLVVVSWCTGVSTGFLPSLMISRLDFCGRNQINHFFCDLPPLMQLSCSRVYITEVTIFILSIAVLCICFFLTLGPYVFIVSSILRIPSTSGRRKTFSTCGSHLAVVTLYYGTMISMYVCPSPHLLPEINKIISVFYTVVTPLLNPVIYSLRNKDFKEAVRKVMRRKCGILWSTSKRKFLY

SEQ ID NO: 12285 - protein, 307 aa, Artificial Sequence
  Description of Artificial Sequence: Synthetic coding sequence
MLNTTSVTEFLLLGVTDIQELQPFLFVVFLTIYFISVTGNGAVLMIVISDPRLHSLMYFFLGNLSYLDICYSTVTLPKMLQNFLSTHKAISFLGCISQLHFFHSLGSTESMLFAVMAFDLSVAICKPLRYTVIMNPQLCTQMAITIWVIGFFHALLHSVMTSRLNFCGSNRIHHFLCDIKPLLKLACGNTELNQWLLSTVTGTIAMGPFFLTLLSYFYIITYLFFKTRSCSMLCKALSTCASHFMVVILFYAPVLFTYIHPALESFMDQDRIVAIMYTVVTPVLNPLIYTLRNKEVKGALGRVIRRL

SEQ ID NO: 12286 - protein, 307 aa, Artificial Sequence
  Description of Artificial Sequence: Synthetic coding sequence
MLNTTSVTEFLLLGVTDIQELQPFLFVVFLTIYFISVTGNGAVLMIFISDPRLHSPMYFFLGNLSYLDICYSTVTLPKMLQNFLSTHKAISFLGCISQLHFFHFLGSTESMLLAVMAFDRSVAICKPLRYTVIMNPQLCTQMAITIWVIGFFHALLHSIMTSRLNFCGSNRIHHFLCDIKPLLKLACGNTELNQWLLSTVTGTIAMGPFFLTLLSYFYIITYLFFKTRSCSMLCKALSTCASHFMVVILFYAPVLFTYIHPALESFMDQDRIVAIMYTVVTPVLNPLIYTLRNKEVKGALGRVIRRL

SEQ ID NO: 12287 - protein, 307 aa, Artificial Sequence
  Description of Artificial Sequence: Synthetic coding sequence
MLNTTSVTEFLLLGVTDIQELQPFLFVVFLTIYFISVTGNGAVLMIFISDPRLHSPMYFFLGNLSYLDICYSTVTLPKMLQNFLSTHKAISFLGCISQLHFFHFLGSTESMLLAVMAFDRCVAICKPLRYTVIMNPQLCTQMAITIWVIGFFHALLHSIMTSRLNFCGSNRIHHFLCDIKPLLKLACGNTELNQWLLSTVTGTIAMGPFFLTLLSYFYIITYLFFKTRSCSMLCKALSTCASHFMVVILFYAPVLFTYIHPALESFMDQDRIVAIMYTVVTPVLNPLIYTLRNKEVKGALGRVIRRL

SEQ ID NO: 12288 - protein, 316 aa, Artificial Sequence
  Description of Artificial Sequence: Synthetic coding sequence
MENVTTMNEFLLLGLTGVQELQPFFFGIFLIIYLINLIGNGSILVMVVLEPQLHSPMYFFLGNLSCLDISYSSVTLPKLLVNLVCSRRAISFLGCITQLHFFHFLGSTEAILLAIMAFDRFVAICNPLRYTVIMNPQVCILLAAAAWLISFFYALMHSVMTAHLSFCGSQKLNHFFYDVKPLLELACSDTLLNQWLLSIVTGSISMGAFFLTLLSCFYVIGFLLFKNRSCRILHKALSTCASHFMVVCLFYGPVGFTYIRPASATSMIQDRIMAIMYSAVTPVLNPLIYTLRNKEVMMALKKIFGRKLFKDWQQHH

SEQ ID NO: 12289 - protein, 316 aa, Artificial Sequence; identical to SEQ ID NO: 12288
  Description of Artificial Sequence: Synthetic coding sequence

SEQ ID NO: 12290 - protein, 316 aa, Artificial Sequence; identical to SEQ ID NO: 12288
  Description of Artificial Sequence: Synthetic coding sequence

SEQ ID NO: 12291 - protein, 316 aa, Artificial Sequence; identical to SEQ ID NO: 12288
  Description of Artificial Sequence: Synthetic coding sequence

SEQ ID NO: 12292 - protein, 316 aa, Artificial Sequence; identical to SEQ ID NO: 12288
  Description of Artificial Sequence: Synthetic coding sequence

SEQ ID NO: 12293 - protein, 316 aa, Artificial Sequence; identical to SEQ ID NO: 12288
  Description of Artificial Sequence: Synthetic coding sequence

SEQ ID NO: 12294 - protein, 316 aa, Artificial Sequence; identical to SEQ ID NO: 12288
  Description of Artificial Sequence: Synthetic coding sequence

SEQ ID NO: 12295 - protein, 316 aa, Artificial Sequence; identical to SEQ ID NO: 12288
  Description of Artificial Sequence: Synthetic coding sequence

SEQ ID NO: 12296 - protein, 328 aa, Artificial Sequence
  Description of Artificial Sequence: Synthetic coding sequence
MKLWMESHLIVPETRPSPRMMSNQTLVTEFILQGFSEHPEYRVFLFSCFLFLYSGALTGNVLITLAITFNPGLHAPMYFFLLNLATMDIICTSSIMPKALASLVSEESSISYGGCMAQLYFLTWAASSELLLLTVMAYDRYAAICHPLHYSSMMSKVFCSGLATAVWLLCAVNTAIHTGLMLRLDFCGPNVIIHFFCEVPPLLLLSCSSTYVNGVMIVLADAFYGIVNFLMTIASYGFIVSSILKVKTAWGRQKAFSTCSSHLTVVCMYYTAVFYAYISPVSGYSAGKSKLAGLLYTVLSPTLNPLIYTLRNKEVKAALRKLFPFFRN

SEQ ID NO: 12297 - protein, 328 aa, Artificial Sequence; identical to SEQ ID NO: 12296
  Description of Artificial Sequence: Synthetic coding sequence

SEQ ID NO: 12298 - protein, 328 aa, Artificial Sequence; identical to SEQ ID NO: 12296
  Description of Artificial Sequence: Synthetic coding sequence

SEQ ID NO: 12299 - protein, 318 aa, Artificial Sequence
  Description of Artificial Sequence: Synthetic coding sequence
MEWENHTILVEFFLKGLSGHPRLELLFFVLIFIMYVVILLGNGTLILISILDPHLHTPMYFFLGNLSFLDICYTTTSIPSTLVSFLSERKTISLSGCAVQMFLGLAMGTTECVLLGMMAFDRYVAICNPLRYPIIMSKDAYVPMAAGSWIIGAVNSAVQSVFVVQLPFCRNNIINHFTCEILAVMKLACADISDNEFIMLVATTLFILTPLLLIIVSYTLIIVSIFKISSSEGRSKASSTCSAHLTVVIIFYGTILFMYMKPKSKETLNSDDLDATDKIISMFYGVMTPMMNPLIYSLRNKDVKEAVKHLLNRRFFSK

SEQ ID NO: 12300 - protein, 347 aa, Artificial Sequence
  Description of Artificial Sequence: Synthetic coding sequence
MIVQLICTVCFLAVNTFHVRSSFDFLKADDMGEINQTLVSEFLLLGLSGYPKIEIVYFALILVMYLVILIGNGVLIIASIFDSHFHTPMYFFLGNLSFLDICYTSSSVPSTLVSLISKKRNISFSGCAVQMFFGFAMGSTECLLLGMMAFDRYVAICNPLRYPIILSKVAYVLMASVSWLSGGINSAVQTLLAMRLPFCGNNIINHFACEILAVLKLACADISLNIITMVISNMAFLVLPLMVIFFSYMFILYTILQMNSATGRRKAFSTCSAHLTVVIIFYGTIFFMYAKPKSQDLIGEEKLQALDKLISLFYGVVTPMLNPILYSLRNKDVKAAVKYLLNKKPIH

SEQ ID NO: 12301 - protein, 318 aa, Artificial Sequence
  Description of Artificial Sequence: Synthetic coding sequence
MDKINQTFVREFILLGLSGYPKLEIIFFALILVMYVVILIGNGVLIIASILDSRLHMPMYFFLGNLSFLDICYTTSSIPSTLVSLISKKRNISFSGCAVQMFFGFAMGSTECFLLGMMAFDRYVAICNPLRYPIIMNKVVYVLLTSVSWLSGGINSTVQTSLAMRWPFCGNNIINHFLCEILAVLKLACSDISVNIVTLAVSNIAFLVLPLLVIFFSYMFILYTILRTNSATGRHKAFSTCSAHLTVVIIFYGTIFFMYAKPKSQDLLGKDNLQATEGLVSMFYGVVTPMLNPIIYSLRNKDVKAAIKYLLSRKAINQ

SEQ ID NO: 12302 - protein, 346 aa, Artificial Sequence
  Description of Artificial Sequence: Synthetic coding sequence
MFIQVIFYICCLAVKILYIGSSFGILKADMDKINQTFVREFILLGLSGYPKLEIIFFALILVMYVVILIGNGVLIIASILDSRLHMPMYFFLGNLSFLDICYTTSSIPSTLVSLISKKRNISFSGCAVQMFFGFAMGSTECFLLGMMAFDRYVAICNPLRYPIIMNKVVYVLLTSVSWLSGGINSTVQTSLAMRWPFCGNNIINHFLCEILAVLKLACSDISVNIVTLAVSNIAFLVLPLLVIFFSYMFILYTILRTNSATGRHKAFSTCSAHLTVVIIFYGTIFFMYAKPKSQDLLGKDNLQATEGLVSMFYGVVTPMLNPIIYSLRNKDVKAAIKYLLSRKAIN

SEQ ID NO: 12303 - protein, 318 aa, Artificial Sequence
  Description of Artificial Sequence: Synthetic coding sequence
MEWENHTILVEFFLKGLSGHPRLELLFFVLIFIMYVVILLGNGTLILISILDPHLHTPMYFFLGNLSFLDICYTTTSIPSTLVSFLSERKTISLSGCAVQMFLSLAMGTTECVLLGVMAFDRYVAICNPLRYPIIMSKDAYVPMAAGSWIIGAVNSAVQTVFVVQLPFCRNNIINHFTCEILAVMKLACADISGNEFILLVTTTLFLLTPLLLIIVSYTLIILSIFKISSSEGRSKPSSTCSARLTVVITFCGTIFLMYMKPKSQETLNSDDLDATDKLIFIFYRVMTPMMNPLIYSLRNKDVKEAVKHLLRRKNFNK

SEQ ID NO: 12304 - protein, 320 aa, Artificial Sequence
  Description of Artificial Sequence: Synthetic coding sequence
MERTNDSTSTEFFLVGLSAHPKLQTVFFVLILWMYLMILLGNGVLISVIIFDSHLHTPMYFFLCNLSFLDVCYTSSSVPLILASFLAVKKKVSFSGCMVQMFISFAMGATECMILGTMALDRYVAICYPLRYPVIMSKGAYVAMAAGSWVTGLVDSVVQTAFAMQLPFCANNVIKHFVCEILAILKLACADISINVISMTGSNLIVLVIPLLVISISYIFIVATILRIPSTEGKHKAFSTCSAHLTVVIIFYGTIFFMYAKPESKASVDSGNEDIIEALISLFYGVMTPMLNPLIYSLRNKDVKAAVKNILCRKNFSDGK

SEQ ID NO: 12305 - protein, 318 aa, Artificial Sequence
  Description of Artificial Sequence: Synthetic coding sequence
MEWENQTILVEFFLKGHSVHPRLELLFFVLIFIMYVVILLGNGTLILISILDPHLHTPMYFFLGNLSFLDICYTTTSIPSTLVSFLSERKTISFSGCAVQMFLGLAMGTTECVLLGMMAFDRYVAICNPLRYPIIMSKNAYVPMAVGSWFAGIVNSAVQTTFVVQLPFCRKNVINHFSCEILAVMKLACADISGNEFLMLVATILFTLMPLLLIVISYSLIISSILKIHSSEGRSKAFSTCSAHLTVVIIFYGTILFMYMKPKSKETLNSDDLDATDKIISMFYGVMTPMMNPLIYSLRNKDVKEAVKHLPNRRFFSK

SEQ ID NO: 12306 - protein, 346 aa, Artificial Sequence
  Description of Artificial Sequence: Synthetic coding sequence
MYRFTDFDVSNISIYLNHVLFYTTQQAGDLEHMETRNYSAMTEFFLVGLSQYPELQLFLFLLCLIMYMIILLGNSLLIIITILDSRLHTPMYFFLGNLSFLDICYTSSSIPPMLIIFMSERKSISFIGCALQMVVSLGLGSTECVLLAVMAYDHYVAICNPLRYSIIMNGVLYVQMAAWSWIIGCLTSLLQTVLTMMLPFCGNNVIDHITCEILALLKLVCSDITINVLIMTVTNIVSLVILLLLIFISYVFILSSILRINCAEGRKKAFSTCSAHSIVVILFYGSALFMYMKPKSKNTNTSDEIIGLSYGVVSPMLNPIIYSLRNKEVKEAVKKVLSRHLHLLKM

SEQ ID NO: 12307 - protein, 319 aa, Artificial Sequence
  Description of Artificial Sequence: Synthetic coding sequence
MFPANWTSVKVFFFLGFFHYPKVQVIIFAVCLLMYLITLLGNIFLISITILDSHLHTPMYLFLSNLSFLDIWYSSSALSPMLANFVSGRNTISFSGCATQMYLSLAMGSTECVLLPMMAYDRYVAICNPLRYPVIMNRRTCVQIAAGSWMTGCLTAMVEMMSVLPLSLCGNSIINHFTCEILAILKLVCVDTSLVQLIMLVISVLLLPMPMLLICISYAFILASILRISSVEGRSKAFSTCTAHLMVVVLFYGTALSMHLKPSAVDSQEIDKFMALVYAGQTPMLNPIIYSLRNKEVKVALKKLLIRNHFNTAFISILK

SEQ ID NO: 12308 - protein, 308 aa, Artificial Sequence
  Description of Artificial Sequence: Synthetic coding sequence
MAMDNVTAVFQFLLIGISNYPQWRDTFFTLVLIIYLSTLLGNGFMIFLIHFDPNLHTPIYFFLSNLSFLDLCYGTASMPQALVHCFSTHPYLSYPRCLAQTSVSLALATAECLLLAAMAYDRVVAISNPLRYSVVMNGPVCVCLVATSWGTSLVLTAMLILSLRLHFCGANVINHFACEILSLIKLTCSDTSLNEFMILITSIFTLLLPFGFVLLSYIRIAMAIIRIRSLQGRLKAFTTCGSHLTVVTIFYGSAISMYMKTQSKSYPDQDKFISVFYGALTPMLNPLIYSLRKKDVKRAIRKVMLKRT

SEQ ID NO: 12309 - protein, 312 aa, Artificial Sequence
  Description of Artificial Sequence: Synthetic coding sequence
MEPLNRTEVSEFFLKGFSGYPALEHLLFPLCSAMYLVTLLGNTAIMAVSVLDIHLHTPVYFFLGNLSTLDICYTPTFVPLMLVHLLSSRKTISFAVCAIQMCLSLSTGSTECLLLAITAYDRYLAICQPLRYHVLMSHRLCVLLMGAAWVLCLLKSVTEMVISMRLPFCGHHVVSHFTCKILAVLKLACGNTSVSEDFLLAGSILLLPVPLAFICLSYLLILATILRVPSAARCCKAFSTCLAHLAVVLLFYGTIIFMYLKPKSKEAHISDEVFTVLYAMVTTMLNPTIYSLRNKEVKEAARKVWGRSRASR

SEQ ID NO: 12310 - protein, 309 aa, Artificial Sequence
  Description of Artificial Sequence: Synthetic coding sequence
MANLTIVTEFILMGFSTNKNMCILHSILFLLIYLCALMGNVLIIMITTLDHHLHTPVYFFLKNLSFLDLCLISVTAPKSIANSLIHNNSISFLGCVSQVFLLLSSASAELLLLTVMSFDRYTAICHPLHYDVIMDRSTCVQRATVSWLYGGLIAVMHTAGTFSLSYCGSNMVHQFFCDIPQLLAISCSENLIREIALILINVVLDFCCFIVIIITYVHVFSTVKKIPSTEGQSKAYSICLPHLLVVLFLSTGFIAYLKPASESPSILDAVISVFYTMLPPTFNPIIYSLRNKAIKVALGMLIKGKLTKK

SEQ ID NO: 12311 - protein, 314 aa, Artificial Sequence
  Description of Artificial Sequence: Synthetic coding sequence
MANVTLVTGFLLMGFSNIQKLRILYGVLFLLIYLAALMSNLLIITLITLDVKLQTPMYFFLKNLSFLDVFLVSVPIPKFIVNNLTHNNSISILGCAFQLLLMTSFSAGEIFILTAMSYDRYVAICCPLNYEVIMNTGVCVLMASVSWAIGGLFGTAYTAGTFSMPFCGSSVIPQFFCDVPSLLRISCSETLMVIYAGIGVGACLSISCFICIVISYIYIFSTVLKIPTTKGQSKAFSTCFPHLTVFTVFIITAYFVYLKPPSNSPSVIDRLLSVIYTVMPPVFNPVTYSLRNNDMKCALIRLLQKTYGQEAYFI

SEQ ID NO: 12312 - protein, 312 aa, Artificial Sequence
  Description of Artificial Sequence: Synthetic coding sequence
MPNSTTVMEFLLMRFSDVWTLQILHSASFFMLYLVTLMGNILIVTVTTCDSSLHMPMYFFLRNLSILDACYISVTVPTSCVNSLLDSTTISKAGCVAQVFLVVFFVYVELLFLTIMAHDRYVAVCQPLHYPVIVNSRICIQMTLASLLSGLVYAGMHTGSTFQLPFCRSNVIHQFFCDIPSLLKLSCSDTFSNEVMIVVSALGVGGGCFIFIIRSYIHIFSTVLGFPRGADRTKAFSTCIPHILVVSVFLSSCSSVYLRPPAIPAATQDLILSGFYSIMPPLFNPIIYSLRNKQIKVAIKKIMKRIFYSENV

SEQ ID NO: 12313 - protein, 321 aa, Artificial Sequence
  Description of Artificial Sequence: Synthetic coding sequence
MVNLTSMSGFLLMGFSDERKLQILHALVFLVTYLLALTGNLLIITIITVDRRLHSPMYYFLKHLSLLDLCFISVTVPQSIANSLMGNGYISLVQCILQVFFFIALASSEVAILTVMSYDRYAAICQPLHYETIMDPRACRHAVIAVWIAGGLSGLMHAAINFSIPLCGKRVIHQFFCDVPQMLKLACSYEFINEIALAAFTTSAAFICLISIVLSYIRIFSTVLRIPSAEGRTKVFSTCLPHLFVATFFLSAAGFEFLRLPSDSSSTVDLVFSVFYTVIPPTLNPVIYSLRNDSMKAALRKMLSKEELPQRKMCLKAMFKL

SEQ ID NO: 12314 - protein, 321 aa, Artificial Sequence; identical to SEQ ID NO: 12313
  Description of Artificial Sequence: Synthetic coding sequence

SEQ ID NO: 12315 - protein, 321 aa, Artificial Sequence; identical to SEQ ID NO: 12313
  Description of Artificial Sequence: Synthetic coding sequence

SEQ ID NO: 12316 - protein, 314 aa, Artificial Sequence
  Description of Artificial Sequence: Synthetic coding sequence
MTNQTQMMEFLLVRFTENWVLLRLHALLFSLIYLTAVLMNLVIILLMILDHRLHMAMYFFLRHLSFLDLCLISATVPKSILNSVASTDSISFLGCVLQLFLVVLLAGSEIGILTAMSYDRYAAICCPLHCEAVMSRGLCVQLMALSWLNRGALGLLYTAGTFSLNFYGSDELHQFFCDVPALLKLTCSKEHAIISVSVAIGVCYAFSCLVCIVVSYVYIFSAVLRISQRQRQSKAFSNCVPHLIVVTVFLVTGAVAYLKPGSDAPSILDLLVSVFYSVAPPTLNPVIYCLKNKDIKSALSKVLWNVRSSGVMKR

SEQ ID NO: 12317 - protein, 310 aa, Artificial Sequence
  Description of Artificial Sequence: Synthetic coding sequence
MGENQTMVTEFLLLGFLLGPRIQMLLFGLFSLFYIFTLLGNGAILGLISLDSRLHTPMYFFLSHLAVVDIAYTRNTVPQMLANLLHPAKPISFAGCMTQTFLCLSFGHSECLLLVLMSYDRYVAICHPLRYSVIMTWRVCITLAVTSWTCGSLLALAHVVLILRLPFSGPHEINHFFCEILSVLRLACADTWLNQVVIFAACVFFLVGPPSLVLVSYSHILAAILRIQSGEGRRKAFSTCSSHLCVVGLFFGSAIIMYMAPKSRHPEEQQKVFFLFYSFFNPTLNPLIYSLRNGEVKGALRRALGKESHS

SEQ ID NO: 12318 - protein, 310 aa, Artificial Sequence
  Description of Artificial Sequence: Synthetic coding sequence
MESNQTWITEVILLGFQVDPALELFLFGFFLLFYSLTLMGNGIILGLIYLDSRLHTPMYVFLSHLAIVDMSYASSTVPKMLANLVMHKKVISFAPCILQTFLYLAFAITECLILVMMCYDRYVAICHPLQYTLIMNWRVCTVLASTCWIFSFLLALVHITLILRLPFCGPQKINHFFCQIMSVFKLACADTRLNQVVLFAGSAFILVGPLCLVLVSYLHILVAILRIQSGEGRRKAFSTCSSHLCVVGLFFGSAIVMYMAPKSSHSQERRKILSLFYSLFNPILNPLIYSLRNAEVKGALKRVLWKQRSM

SEQ ID NO: 12319 - protein, 310 aa, Artificial Sequence
  Description of Artificial Sequence: Synthetic coding sequence
MEGNKTWITDITLPRFQVGPALEILLCGLFSAFYTLTLLGNGVIFGIICLDCKLHTPMYFFLSHLAIVDISYASNYVPKMLTNLMNQESTISFFPCIMQTFLYLAFAHVECLILVVMSYDRYADICHPLRYNSLMSWRVCTVLAVASWVFSFLLALVPLVLILSLPFCGPHEINHFFCEILSVLKLACADTWLNQVVIFAACVFILVGPLCLVLVSYLRILAAILRIQSGEGRRKAFSTCSSHLCVVGLFFGSAIVTYMAPKSRHPEEQQKVLSLFYSLFNPMLNPLIYSLRNAEVKGALRRALRKERLT

SEQ ID NO: 12320 - protein, 318 aa, Artificial Sequence
  Description of Artificial Sequence: Synthetic coding sequence
MEGNQTWITDITLLGFQVGPALAILLCGLFSVFYTLTLLGNGVIFGIICLDSKLHTPMYFFLSHLAIIDMSYASNNVPKMLANLMNQKRTISFVPCIMQTFLYLAFAVTECLILVVMSYDRYVAICHPFQYTVIMSWRVCTILVLTSWSCGFALSLVHEILLLRLPFCGPRDVNHLFCEILSVLKLACADTWVNQVVIFATCVFVLVGPLSLILVSYMHILGAILKIQTKEGRIKAFSTCSSHLCVVGLFFGIAMVVYMVPDSNQREEQEKMLSLFHSVFNPMLNPLIYSLRNAQLKGALHRALQRKRSMRTVYGLCL

SEQ ID NO: 12321 - protein, 310 aa, Artificial Sequence
  Description of Artificial Sequence: Synthetic coding sequence
MGGNQTSITEFLLLGFPIGPRIQMLLFGLFSLFYIFILLGNGTILGLISLDSRLHTPMYFFLSHLAVVDIACACSTVPQMLVNLLHPAKPISFAGCMTQMFLFLSFAHTECLLLVVMSYDRYVAICHPLRYSTIMTWKVCITLALTSWILGVLLALVHLVLLLPLSFCGPQKLNHFFCEIMAVLKLACADTHINEVMVLAGAVSVLVGAFFSTVISYVHILCAILKIQSGEGCQKAFSICSSHLCVVGLFYGTAIIMYVEPQYESPKEQKKYLLLFHSLFNPMLNPLIYSLRNKEVQGTLKRMLEKKRTS

SEQ ID NO: 12322 - protein, 310 aa, Artificial Sequence
  Description of Artificial Sequence: Synthetic coding sequence
MGDNITSIREFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLAIMTWRVCITLAVTSWTTGVLLSLIHLVLLLPLPFCRPQKIYHFFCEILAVLKLACADTHINENMVLAGAISGLVGPLSTIVVSYMCILCAILQIQSREVQRKAFRTCFSHLCVIGLVYGTAIIMYVGPRYGNPKEQKKYLLLFHSLFNPMLNPLICSLRNSEVKNTLKRVLGVERAL

SEQ ID NO: 12323 - protein, 310 aa, Artificial Sequence; identical to SEQ ID NO: 12317
  Description of Artificial Sequence: Synthetic coding sequence

SEQ ID NO: 12324 - protein, 311 aa, Artificial Sequence
  Description of Artificial Sequence: Synthetic coding sequence
MTKNQTWVTEFILLGFPLSLRIQMLLSGLFSLLYVFTLLGNGAILGLIWLDSRLHTPMYFFLSHLAIIDISYASNNVPKMLTNLGLNKRKTISFVPCTMQTFLYMAFAHTECLILVMMSYDRYMAICHPLQYSVIMRWGVCTVLAVTSWACGSLLALVHVVLILRLPFCGPHEINHFFCEILSVLKLACADTWLNQVVIFAASVFILVGPLCLVLVSYSRILAAILRIQSGEGRRKAFSTCSSHLCMVGLFFGSAIVMYMAPKSRHPEEQQKVLSLFYSLFNPMLNPLIYSLRNAEVKGALKRVLWKQRSK

SEQ ID NO: 12325 - protein, 310 aa, Artificial Sequence
  Description of Artificial Sequence: Synthetic coding sequence
MGDNITSITEFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLAIMTWRVCITLAVTSWTTGVLLSLIHLVLLLPLPFCRPQKIYHFFCEILAVLKLACADTHINENMVLAGAISGLVGPLSTIVVSYMCILCAILQIQSREVQRKAFCTCFSHLCVIGLFYGTAIIMYVGPRYGNPKEQKKYLLLFHSLFNPMLNPLICSLRNSEVKNTLKRVLGVERAL

SEQ ID NO: 12326 - protein, 323 aa, Artificial Sequence
  Description of Artificial Sequence: Synthetic coding sequence
MWQKNQTSLADFILEGLFDDSLTHLFLFSLTMVVFLIAVSGNTLTILLICIDPQLHTPMYFLLSQLSLMDLMHVSTIILKMATNYLSGKKSISFVGCATQHFLYLCLGGAECFLLAVMSYDRYVAICHPLRYAVLMNKKVGLMMAVMSWLGASVNSLIHMAILMHFPFCGPRKVYHFYCEFPAVVKLVCGDITVYETTVYISSILLLLPIFLISTSYVFILQSVIQMRSSGSKRNAFATCGSHLTVVSLWFGACIFSYMRPRSQCTLLQNKVGSVFYSIITPTLNSLIYTLRNKDVAKALRRVLRRDVITQCIQRLQLWLPRV

SEQ ID NO: 12327 - protein, 316 aa, Artificial Sequence
  Description of Artificial Sequence: Synthetic coding sequence
MELWNFTLGSGFILVGILNDSGSPELLCATITILYLLALISNGLLLLAITMEARLHMPMYLLLGQLSLMDLLFTSVVTPKALADFLRRENTISFGGCALQMFLALTMGGAEDLLLAFMAYDRYVAICHPLTYMTLMSSRACWLMVATSWILASLSALIYTVYTMHYPFCRAQEIRHLLCEIPHLLKVACADTSRYELMVYVMGVTFLIPSLAAILASYTQILLTVLHMPSNEGRKKALVTCSSHLTVVGMFYGAATFMYVLPSSFHSTRQDNIISVFYTIVTPALNPLIYSLRNKEVMRALRRVLGKYMLPAHSTL

SEQ ID NO: 12328 - protein, 328 aa, Artificial Sequence
  Description of Artificial Sequence: Synthetic coding sequence
MGHQNHTFSSDFILLGLFSSSPTSVVFFLVLFVIFIMSVTENTLMILLIRSDSRLHTPMYFLLSHLSLMDILHVSNIVPKMVTNFLSGSRTISFAGCGFQVFLSLTLLGGECLLLAAMSCDRYVAICHPLRYPILMKEYASALMAGGSWLIGVFNSTVHTAYALQFPFCGSRAIDHFFCEVPAMLKLSCADTTRYERGVCVSAVIFLLIPFSLISASYGQIILTVLQMKSSEARKKSFSTCSFHMIVVTMYYGPFIFTYMRPKSYHTPGQDKFLAIFYTILTPTLNPFIYSFRNKDVLAVMKNMLKSNFLHKKMNRKIPECVFCLFLC

SEQ ID NO: 12329 - protein, 335 aa, Artificial Sequence
  Description of Artificial Sequence: Synthetic coding sequence
MNISDVISFDILVSAMKTGNQSFGTDFLLVGLFQYGWINSLLFVVIATLFTVALTGNIMLIHLIRLNTRLHTPMYFLLSQLSIVDLMYISTTVPKMAVSFLSQSKTIRFLGCEIQTYVFLALGGTEALLLGFMSYDRYVAICHPLHYPMLMSKKICCLMVACAWASGSINAFIHTLYVFQLPFCRSRLINHFFCEVPALLSLVCQDTSQYEYTVLLSGLIILLLPFLAILASYARVLIVVFQMSSGKGQAKAVSTCSSHLIVASLFYATTLFTYTRPHSLRSPSRDKAVAVFYTIVTPLLNPFIYSLRNKEVTGAVRRLLGYWICCRKYDFRSLY

SEQ ID NO: 12330 - protein, 309 aa, Artificial Sequence
  Description of Artificial Sequence: Synthetic coding sequence
MKNKTVLTEFILLGLTDVPELQVAVFTFLFLAYLLSILGNLTILILTLLDSHLQTPMYFFLRNFSFLEISFTNIFIPRVLISITTGNKSISFAGCFTQYFFAMFLGATEFYLLAAMSYDRYVAICKPLHYTTIMSSRICIQLIFCSWLGGLMAIIPTITLMSQQDFCASNRLNHYFCDYEPLLELSCSDTSLIEKVVFLVASVTLVVTLVLVILSYAFIIKTILKLPSAQQRTKAFSTCSSHMIVISLSYGSCMFMYINPSAKEGDTFNKGVALLITSVAPLLNPFIYTLRNQQVKQPFKDMVKKLLNL

SEQ ID NO: 12331 - protein, 320 aa, Artificial Sequence
  Description of Artificial Sequence: Synthetic coding sequence
MDATACNESVDGSPVFYLLGIPSLPETFFLPVFFIFLLFYLLILMGNALILVAVVAEPSLHKPMYFFLINLSTLDILFTTTTVPKMLSLFLLGDRFLSFSSCLLQMYLFQSFTCSEAFILVVMAYDRYVAICHPLHYPVLMNPQTNATLAASAWLTALLLPIPAVVRTSQMAYNSIAYIYHCFCDHLAVVQASCSDTTPQTLMGFCIAMVVSFLPLLLVLLSYVHILASVLRISSLEGRAKAFSTCSSHLLVVGTYYSSIAIAYVAYRADLPLDFHIMGNVVYAILTPILNPLIYTLRNRDVKAAITKIMSQDPGCDRSI

SEQ ID NO: 12332 - protein, 317 aa, Artificial Sequence
  Description of Artificial Sequence: Synthetic coding sequence
MKSDNHSFLGDSPKAFILLGVSDRPWLELPLFVVLLLSYVLAMLGNVAIILASRVDPQLHSPMYIFLSHLSFLDLCYTTTTVPQMLVNMGSSQKTISYGGCTVQYAVFHWLGCTECIVLAAMALDRYVAICKPLHYAVLMHRALCQQLVALAWLSGFGNSFVQVVLTVQLPFCGRQVLNNFFCEVPAVIKLSCADTAVNDTILAVLVAFFVLVPLALILLSYGFIARAVLRIQSSKGRHKAFGTCSSHLMIVSLFYLPAIYMYLQPPSSYSQEQGKFISLFYSIITPTLNPFTYTLRNKDMKGALRRLLARIWRLCG

SEQ ID NO: 12333 - protein, 357 aa, Artificial Sequence
  Description of Artificial Sequence: Synthetic coding sequence
MNWVNKSVPQEFILLVFSDQPWLEIPPFVMFLFSYILTIFGNLTIILVSHVDFKLHTPMYFFLSNLSLLDLCYTTSTVPQMLVNICNTRKVISYGGCVAQLFIFLALGSTECLLLAVMCFDRFVAICRPLHYSIIMHQRLCFQLAAASWISGFSNSVLQSTWTLKMPLCGHKEVDHFFCEVPALLKLSCVDTTANEAELFFISVLFLLIPVTLILISYAFIVQAVLRIQSAEGQRKAFGTCGSHLIVVSLFYGTAISMYLQPPSPSSKDRGKMVSLFCGIIAPMLNPLIYTLRNKEVKEAFKRLVAKSLLNQEIRNMQMISFAKDTVLTYLTNFSASCPIFVITIENYCNLPQRKFP

SEQ ID NO: 12334 - protein, 313 aa, Artificial Sequence
  Description of Artificial Sequence: Synthetic coding sequence
MNWENESSPKEFILLGFSDRAWLQMPLFVVLLISYTITIFGNVSIMMVCILDPKLHTPMYFFLTNLSILDLCYTTTTVPHMLVNIGCNKKTISYAGCVAHLIIFLALGATECLLLAVMSFDRYVAVCRPLHYVVIMNYWFCLRMAAFSWLIGFGNSVLQSSLTLNMPRCGHQEVDHFFCEVPALLKLSCADTKPIEAELFFFSVLILLIPVTLILISYGFIAQAVLKIRSAEGRQKAFGTCGSHMIVVSLFYGTAIYMYLQPPSSTSKDWGKMVSLFYGIITSMLNSLIYSLRNKDMKEAFKRLMPRIFFCKK

SEQ ID NO: 12335 - protein, 313 aa, Artificial Sequence; identical to SEQ ID NO: 12334
  Description of Artificial Sequence: Synthetic coding sequence

SEQ ID NO: 12336 - protein, 313 aa, Artificial Sequence; identical to SEQ ID NO: 12334
  Description of Artificial Sequence: Synthetic coding sequence

SEQ ID NO: 12337 - protein, 313 aa, Artificial Sequence; identical to SEQ ID NO: 12334
  Description of Artificial Sequence: Synthetic coding sequence

SEQ ID NO: 12338 - protein, 313 aa, Artificial Sequence; identical to SEQ ID NO: 12334
  Description of Artificial Sequence: Synthetic coding sequence

SEQ ID NO: 12339 - protein, 313 aa, Artificial Sequence; identical to SEQ ID NO: 12334
  Description of Artificial Sequence: Synthetic coding sequence

SEQ ID NO: 12340 - protein, 313 aa, Artificial Sequence; identical to SEQ ID NO: 12334
  Description of Artificial Sequence: Synthetic coding sequence

SEQ ID NO: 12341 - protein, 313 aa, Artificial Sequence; identical to SEQ ID NO: 12334
  Description of Artificial Sequence: Synthetic coding sequence

SEQ ID NO: 12342 - protein, 313 aa, Artificial Sequence
  Description of Artificial Sequence: Synthetic coding sequence
MNWVNDSIIQEFILLGFSDRPWLEFPLLVVFLISYTVTIFGNLTIILVSRLDTKLHTPMYFFLTNLSLLDLCYTTCTVPQMLVNLCSIRKVISYRGCVAQLFIFLALGATEYLLLAVMSFDRFVAICRPLHYSVIMHQRLCLQLAAASWVTGFSNSVWLSTLTLQLPLCDPYVIDHFLCEVPALLKLSCVETTANEAELFLVSELFHLIPLTLILISYAFIVRAVLRIQSAEGRQKAFGTCGSHLIVVSLFYSTAVSVYLQPPSPSSKDQGKMVSLFYGIIAPMLNPLIYTLRNKEVKEGFKRLVARVFLIKK

SEQ ID NO: 12343 - protein, 312 aa, Artificial Sequence
  Description of Artificial Sequence: Synthetic coding sequence
MDGVNDSSLQGFVLMGISDHPQLEMIFFIAILFSYLLTLLGNSTIILLSRLEARLHTPMYFFLSNLSSLDLAFATSSVPQMLINLWGPGKTISYGGCITQLYVFLWLGATECILLVVMAFDRYVAVCRPLRYTAIMNPQLCWLLAVIACLGGLGNSVIQSTFTLQLPLCGHRRVEGFLCEVPAMIKLACGDTSLNQAVLNGVCTFFTAVPLSIIVISYCLIAQAVLKIRSAEGRRKAFNTCLSHLLVVFLFYGSASYGYLLPAKNSKQDQGKFISLFYSLVTPMVNPLIYTLRNMEVKGALRRLLGKGREVG

SEQ ID NO: 12344 - protein, 320 aa, Artificial Sequence
  Description of Artificial Sequence: Synthetic coding sequence
MMEIANVSSPEVFVLLGFSTRPSLETVLFIVVLSFYMVSILGNGIIILVSHTDVHLHTPMYFFLANLPFLDMSFTTSIVPQLLANLWGPQKTISYGGCVVQFYISHWLGATECVLLATMSYDRYAAICRPLHYTVIMHPQLCLGLALASWLGGLTTSMVGSTLTMLLPLCGNNCIDHFFCEMPLIMQLACVDTSLNEMEMYLASFVFVVLPLGLILVSYGHIARAVLKIRSAEGRRKAFNTCSSHVAVVSLFYGSIIFMYLQPAKSTSHEQGKFIALFYTVVTPALNPLIYTLRNTEVKSALRHMVLENCCGSAGKLAQI

SEQ ID NO: 12345 - protein, 308 aa, Artificial Sequence
  Description of Artificial Sequence: Synthetic coding sequence
MRQINQTQVTEFLLLGLSDGPHTEQLLFIVLLGVYLVTVLGNLLLISLVHVDSQLHTPMYFFLCNLSLADLCFSTNIVPQALVHLLSRKKVIAFTLCAARLLFFLIFGCTQCALLAVMSYDRYVAICNPLRYPNIMTWKVCVQLATGSWTSGILVSVVDTTFILRLPYRGSNSIAHFFCEAPALLILASTDTHASEMAIFLMGVVILLIPVFLILVSYGRIIVTVVKMKSTVGSLKAFSTCGSHLMVVILFYGSAIITYMTPKSSKQQEKSVSVFYAIVTPMLNPLIYSLRNKDVKAALRKVATRNFP

SEQ ID NO: 12346 - protein, 330 aa, Artificial Sequence
  Description of Artificial Sequence: Synthetic coding sequence
MCSFFLCQTGKQAKISMGEENQTFVSKFIFLGLSQDLQTQILLFILFLIIYLLTVLGNQLIIILIFLDSRLHTPMYFFLRNLSFADLCFSTSIVPQVLVHFLVKRKTISFYGCMTQIIVFLLVGCTECALLAVMSYDRYVAVCKPLYYSTIMTQRVCLWLSFRSWASGALVSLVDTSFTFHLPYWGQNIINHYFCEPPALLKLASIDTYSTEMAIFSMGVVILLAPVSLILGSYWNIISTVIQMQSGEGRLKAFSTCGSHLIVVVLFYGSGIFTYMRPNSKTTKELDKMISVFYTAVTPMLNPIIYSLRNKDVKGALRKLVGRKCFSHRQ

SEQ ID NO: 12347 - protein, 317 aa, Artificial Sequence
  Description of Artificial Sequence: Synthetic coding sequence
MGTDNQTWVSEFILLGLSSDWDTRVSLFVLFLVMYVVTVLGNCLIVLLIRLDSRLHTPMYFFLTNLSLVDVSYATSVVPQLLAHFLAEHKAIPFQSCAAQLFFSLALGGIEFVLLAVMAYDRYVAVCDALRYSAIMHGGLCARLAITSWVSGFISSPVQTAITFQLPMCRNKFIDHISCELLAVVRLACVDTSSNEVTIMVSSIVLLMTPFCLVLLSYIQIISTILKIQSREGRKKAFHTCASHLTVVALCYGVAIFTYIQPHSSPSVLQEKLFSVFYAILTPMLNPMIYSLRNKEVKGAWQKLLWKFSGLTSKLAT

SEQ ID NO: 12348 - protein, 317 aa, Artificial Sequence
  Description of Artificial Sequence: Synthetic coding sequence
MEIDNQTWVREFILLGLSSDWCTQISLFSLFLVTYLMTVLGNCLIVLLIRLDSRLHTPMYFFLTNLSLVDVSYATSVVPQLLAHFLAEHKAIPFQSCAAQLFFSLALGGIEFVLLAVMAYDRHVAVSDRLRYSAIMHGGLCARLAITSWVSGSINSLVQTAITFQLPMCTNKFIDHISCELLAVVRLACVDTSSNEAAIMVSSIVLLMTPFCLVLLSYIRIISTILKIQSREGRKKAFHTCASHLTVVALCYGTTIFTYIQPHSGPSVLQEKLISVFYAIVMPLLNPVIYSLRNKEVKGAWHKLLEKFSGLTSKLGT

SEQ ID NO: 12349 - protein, 317 aa, Artificial Sequence
  Description of Artificial Sequence: Synthetic coding sequence
MGMVRHTNESNLAGFILLGFSDYPQLQKVLFVLILILYLLTILGNTTIILVSRLEPKLHMPMYFFLSHLSFLYRCFTSSVIPQLLVNLWEPMKTIAYGGCLVHLYNSHALGSTECVLPAVMSCDRYVAVCRPLHYTVLMHIHLCMALASMAWLSGIATTLVQSTLTLQLPFCGHRQVDHFICEVPVLIKLACVGTTFNEAELFVASILFLIVPVSFILVSSGYIAHAVLRIKSATRRQKAFGTCFSHLTVVTIFYGTIIFMYLQPAKSRSRDQGKFVSLFYTVVTRMLNPLIYTLRIKEVKGALKKVLAKALGVNIL

SEQ ID NO: 12350 - protein, 309 aa, Artificial Sequence
  Description of Artificial Sequence: Synthetic coding sequence
MGLGNESSLMDFILLGFSDHPRLEAVLFVFVLFFYLLTLVGNFTIIIISYLDPPLHTPMYFFLSNLSLLDICFTTSLAPQTLVNLQRPKKTITYGGCVAQLYISLALGSTECILLADMALDRYIAVCKPLHYVVIMNPRLCQQLASISWLSGLASSLIHATFTLQLPLCGNHRLDHFICEVPALLKLACVDTTVNELVLFVVSVLFVVIPPALISISYGFITQAVLRIKSVEARHKAFSTCSSHLTVVIIFYGTIIYVYLQPSDSYAQDQGKFISLFYTMVTPTLNPIIYTLRNKDMKEALRKLLSGKL

SEQ ID NO: 12351 - protein, 316 aa, Artificial Sequence
  Description of Artificial Sequence: Synthetic coding sequence
MEETNNSSEKGFLLLGFSDQPQLERFLFAIILYFYVLSLLGNTALILVCCLDSRLHTPMYFFLSNLSCVDICFTTSVAPQLLVTMNKKDKTMSYGGCVAQLYVAMGLGSSECILLAVMAYDRYAAVCRPLRYIAIMHPRFCASLAGGAWLSGLITSLIQCSLTVQLPLCGHRTLDHIFCEVPVLIKLACVDTTFNEAELFVASVVFLIVPVLLILVSYGFITQAVLRIKSAAGRQKAFGTCSSHLVVVIIFYGTIIFMYLQPANRRSKNQGKFVSLFYTIVTPLLNPIIYTLRNKDVKGALRTLILGSAAGQSHKD

SEQ ID NO: 12352 - protein, 316 aa, Artificial Sequence
  Description of Artificial Sequence: Synthetic coding sequence
MVNQSSPMGFLLLGFSEHPALERTLFVVVFTSYLLTLVGNTLIILLSVLYPRLHSPMYFFLSDLSFLDLCFTTSCVPQMLVNLWGPKKTISFLGCSVQLFIFLSLGTTECILLTVMAFDRYVAVCQPLHYATIIHPRLCWQLASVAWVMSLVQSIVQTPSTLHLPFCPHQQIDDFLCEVPSLIRLSCGDTSYNEIQLAVSSVIFVVVPLSLILASYGATAQAVLRINSATAWRKAFGTCSSHLTVVTLFYSSVIAVYLQPKNPYAQGRGKFFGLFYAVGTPSLNPLVYTLRNKEIKRALRRLLGKERDSRESWRAA

SEQ ID NO: 12353 - protein, 316 aa, Artificial Sequence; identical to SEQ ID NO: 12352
  Description of Artificial Sequence: Synthetic coding sequence

SEQ ID NO: 12354 - protein, 316 aa, Artificial Sequence; identical to SEQ ID NO: 12352
  Description of Artificial Sequence: Synthetic coding sequence

SEQ ID NO: 12355 - protein, 316 aa, Artificial Sequence; identical to SEQ ID NO: 12352
  Description of Artificial Sequence: Synthetic coding sequence

SEQ ID NO: 12356 - protein, 316 aa, Artificial Sequence; identical to SEQ ID NO: 12352
  Description of Artificial Sequence: Synthetic coding sequence

SEQ ID NO: 12357 - protein, 316 aa, Artificial Sequence; identical to SEQ ID NO: 12352
  Description of Artificial Sequence: Synthetic coding sequence

SEQ ID NO: 12358 - protein, 316 aa, Artificial Sequence; identical to SEQ ID NO: 12352
  Description of Artificial Sequence: Synthetic coding sequence

SEQ ID NO: 12359 - protein, 316 aa, Artificial Sequence; identical to SEQ ID NO: 12352
  Description of Artificial Sequence: Synthetic coding sequence

SEQ ID NO: 12360 - protein, 316 aa, Artificial Sequence; identical to SEQ ID NO: 12352
  Description of Artificial Sequence: Synthetic coding sequence

SEQ ID NO: 12361 - protein, 316 aa, Artificial Sequence; identical to SEQ ID NO: 12352
  Description of Artificial Sequence: Synthetic coding sequence

SEQ ID NO: 12362 - protein, 316 aa, Artificial Sequence; identical to SEQ ID NO: 12352
  Description of Artificial Sequence: Synthetic coding sequence

SEQ ID NO: 12363 - protein, 316 aa, Artificial Sequence; identical to SEQ ID NO: 12352
  Description of Artificial Sequence: Synthetic coding sequence

SEQ ID NO: 12364 - protein, 316 aa, Artificial Sequence; identical to SEQ ID NO: 12352
  Description of Artificial Sequence: Synthetic coding sequence

SEQ ID NO: 12365 - protein, 316 aa, Artificial Sequence; identical to SEQ ID NO: 12352
  Description of Artificial Sequence: Synthetic coding sequence

SEQ ID NO: 12366 - protein, 316 aa, Artificial Sequence; identical to SEQ ID NO: 12352
  Description of Artificial Sequence: Synthetic coding sequence

SEQ ID NO: 12367 - protein, 316 aa, Artificial Sequence; identical to SEQ ID NO: 12352
  Description of Artificial Sequence: Synthetic coding sequence

SEQ ID NO: 12368 - protein, 316 aa, Artificial Sequence; identical to SEQ ID NO: 12352
  Description of Artificial Sequence: Synthetic coding sequence

SEQ ID NO: 12369 - protein, 316 aa, Artificial Sequence; identical to SEQ ID NO: 12352
  Description of Artificial Sequence: Synthetic coding sequence

SEQ ID NO: 12370 - protein, 316 aa, Artificial Sequence; identical to SEQ ID NO: 12352
  Description of Artificial Sequence: Synthetic coding sequence

SEQ ID NO: 12371 - protein, 316 aa, Artificial Sequence; identical to SEQ ID NO: 12352
  Description of Artificial Sequence: Synthetic coding sequence

SEQ ID NO: 12372 - protein, 316 aa, Artificial Sequence; identical to SEQ ID NO: 12352
  Description of Artificial Sequence: Synthetic coding sequence

SEQ ID NO: 12373 - protein, 316 aa, Artificial Sequence; identical to SEQ ID NO: 12352
  Description of Artificial Sequence: Synthetic coding sequence

SEQ ID NO: 12374 - protein, 316 aa, Artificial Sequence; identical to SEQ ID NO: 12352
  Description of Artificial Sequence: Synthetic coding sequence

SEQ ID NO: 12375 - protein, 316 aa, Artificial Sequence; identical to SEQ ID NO: 12352
  Description of Artificial Sequence: Synthetic coding sequence

SEQ ID NO: 12376 - protein, 316 aa, Artificial Sequence; identical to SEQ ID NO: 12352
  Description of Artificial Sequence: Synthetic coding sequence

SEQ ID NO: 12377 - protein, 316 aa, Artificial Sequence; identical to SEQ ID NO: 12352
  Description of Artificial Sequence: Synthetic coding sequence

SEQ ID NO: 12378 - protein, 316 aa, Artificial Sequence; identical to SEQ ID NO: 12352
  Description of Artificial Sequence: Synthetic coding sequence

SEQ ID NO: 12379 - protein, 316 aa, Artificial Sequence; identical to SEQ ID NO: 12352
  Description of Artificial Sequence: Synthetic coding sequence

SEQ ID NO: 12380 - protein, 316 aa, Artificial Sequence; identical to SEQ ID NO: 12352
  Description of Artificial Sequence: Synthetic coding sequence

SEQ ID NO: 12381 - protein, 316 aa, Artificial Sequence; identical to SEQ ID NO: 12352
  Description of Artificial Sequence: Synthetic coding sequence

SEQ ID NO: 12382 - protein, 316 aa, Artificial Sequence; identical to SEQ ID NO: 12352
  Description of Artificial Sequence: Synthetic coding sequence

SEQ ID NO: 12383 - protein, 316 aa, Artificial Sequence; identical to SEQ ID NO: 12352
  Description of Artificial Sequence: Synthetic coding sequence

SEQ ID NO: 12384 - protein, 316 aa, Artificial Sequence; identical to SEQ ID NO: 12352
  Description of Artificial Sequence: Synthetic coding sequence

SEQ ID NO: 12385 - protein, 316 aa, Artificial Sequence; identical to SEQ ID NO: 12352
  Description of Artificial Sequence: Synthetic coding sequence

SEQ ID NO: 12386 - protein, 316 aa, Artificial Sequence; identical to SEQ ID NO: 12352
  Description of Artificial Sequence: Synthetic coding sequence

SEQ ID NO: 12387 - protein, 316 aa, Artificial Sequence; identical to SEQ ID NO: 12352
  Description of Artificial Sequence: Synthetic coding sequence

SEQ ID NO: 12388 - protein, 316 aa, Artificial Sequence; identical to SEQ ID NO: 12352
  Description of Artificial Sequence: Synthetic coding sequence

SEQ ID NO: 12389 - protein, 316 aa, Artificial Sequence; identical to SEQ ID NO: 12352
  Description of Artificial Sequence: Synthetic coding sequence

SEQ ID NO: 12390 - protein, 316 aa, Artificial Sequence; identical to SEQ ID NO: 12352
  Description of Artificial Sequence: Synthetic coding sequence

SEQ ID NO: 12391 - protein, 316 aa, Artificial Sequence; identical to SEQ ID NO: 12352
  Description of Artificial Sequence: Synthetic coding sequence

SEQ ID NO: 12392 - protein, 312 aa, Artificial Sequence
  Description of Artificial Sequence: Synthetic coding sequence
MVNQSSTPGFLLLGFSEHPGLERTLFVVVLTSYLLTLVGNTLIILLSALDPKLHSPMYFFLSNLSFLDLCFTTSCVPQMLVNLWGPKKTISFLDCSVQIFIFLSLGTTECILLTVMAFDRYVAVCQPLHYATIIHPRLCWQLASVAWVIGLVESVVQTPSTLHLPFCPDRQVDDFVCEVPALIRLSCEDTSYNEIQVAVASVFILVVPLSLILVSYGAITWAVLRINSAKGRRKAFGTCSSHLTVVTLFYSSVIAVYLQPKNPYAQERGKFFGLFYAVGTPSLNPLIYTLRNKEVTRAFRRLLGKEMGLTQS

SEQ ID NO: 12393 - protein, 312 aa, Artificial Sequence; identical to SEQ ID NO: 12392
  Description of Artificial Sequence: Synthetic coding sequence

SEQ ID NO: 12394 - protein, 312 aa, Artificial Sequence; identical to SEQ ID NO: 12392
  Description of Artificial Sequence: Synthetic coding sequence

SEQ ID NO: 12395 - protein, 312 aa, Artificial Sequence
  Description of Artificial Sequence: Synthetic coding sequence
MLMKKNASFEDFFLLLGFSNWPHLEVVLFVVILIFYLITLIGNLFIIILSYLDSHLHTPMYFFLSNLSFLDLCYTTSSIPQLLVNLWGPEKTISYAGCTVQLYFVLALGTAECVLLVVMSYDRYAAVCRPLHYTVLMHPRFCRLLAAASWVSGFTTSALHSSFTFWIPLCRHRLVDHFFCEVPALLRLSCVDTQANELTLMVMSSIFVLIPLILILTSYGAIARAVLSMQSTTGLQKVLRTCGAHLMVVSLFFIPVMCMYLQPPSENSQDQGKFIALFYTVVTPSLNPLIYTFRNKDVRGAVKRLMGWEWGM

SEQ ID NO: 12396 - protein, 312 aa, Artificial Sequence
  Description of Artificial Sequence: Synthetic coding sequence
MMIKKNASSEDFFILLGFSNWPQLEVVLFVVILIFYLMTLTGNLFIIILSYVDSHLHTPMYFFLSNLSFLDLCHTTSSIPQLLVNLRGPEKTISYAGCMVQLYFVLALGIAECVLLVVMSYDRYVAVCRPLHYTVLMHPRFCHLLAAASWVIGFTISALHSSFTFWVPLCGHRLVDHFFCEVPALLRLSCVDTHANELTLMVMSSIFVLIPLILILTAYGAIARAVLSMQSTTGLQKVFRTCGAHLMVVSLFFIPVMCMYLQPPSENSPDQGKFIALFYTVVTPSLNPLIYTLRNKHVKGAAKRLLGWEWGK

SEQ ID NO: 12397 - protein, 312 aa, Artificial Sequence; identical to SEQ ID NO: 12396
  Description of Artificial Sequence: Synthetic coding sequence

SEQ ID NO: 12398 - protein, 312 aa, Artificial Sequence; identical to SEQ ID NO: 12396
  Description of Artificial Sequence: Synthetic coding sequence

SEQ ID NO: 12399 - protein, 312 aa, Artificial Sequence; identical to SEQ ID NO: 12396
  Description of Artificial Sequence: Synthetic coding sequence

SEQ ID NO: 12400 - protein, 312 aa, Artificial Sequence; identical to SEQ ID NO: 12396
  Description of Artificial Sequence: Synthetic coding sequence

SEQ ID NO: 12401 - protein, 311 aa, Artificial Sequence
  Description of Artificial Sequence: Synthetic coding sequence
MNDDGKVNASSEGYFILVGFSNWPHLEVVIFVVVLIFYLMTLIGNLFIIILSYLDSHLHTPMYFFLSNLSFLDLCYTTSSIPQLLVNLWGPEKTISYAGCMIQLYFVLALGTTECVLLVVMSYDRYAAVCRPLHYTVLMHPRFCHLLAVASWVSGFTNSALHSSFTFWVPLCGHRQVDHFFCEVPALLRLSCVDTHVNELTLMITSSIFVLIPLILILTSYGAIVRAVLRMQSTTGLQKVFGTCGAHLMAVSLFFIPAMCIYLQPPSGNSQDQGKFIALFYTVVTPSLNPLIYTLRNKVVRGAVKRLMGWE

SEQ ID NO: 12402 - protein, 311 aa, Artificial Sequence; identical to SEQ ID NO: 12401
  Description of Artificial Sequence: Synthetic coding sequence

SEQ ID NO: 12403 - protein, 311 aa, Artificial Sequence; identical to SEQ ID NO: 12401
  Description of Artificial Sequence: Synthetic coding sequence

SEQ ID NO: 12404 - protein, 311 aa, Artificial Sequence; identical to SEQ ID NO: 12401
  Description of Artificial Sequence: Synthetic coding sequence

SEQ ID NO: 12405 - protein, 258 aa, Artificial Sequence
  Description of Artificial Sequence: Synthetic coding sequence
MNDDGKVNASSEGYFILVGFSNWPHLEVVIFVVVLIFYLMTLIGNLFIIILSYLDSHLHTPMYFFLSNLSFLDLCYTTSSIPQLLVNLWGPEKTISYAGCMIQLYFVLALGTTECVLLVVMSYDRYAAVCRPLHYTVLMHPRFCHLLAVASWVSGFTNSALHSSFTFWVPLCGHRQVDHFFCEVPALLRLSCVDTHVNELTLMITSSIFVLIPLILILTSYGAIVQAVLRMQSTTGLQKVFGTCGAHLMAVSLFFIPA

SEQ ID NO: 12406 - protein, 311 aa, Artificial Sequence; identical to SEQ ID NO: 12401
  Description of Artificial Sequence: Synthetic coding sequence

SEQ ID NO: 12407 - protein, 311 aa, Artificial Sequence; identical to SEQ ID NO: 12401
  Description of Artificial Sequence: Synthetic coding sequence

SEQ ID NO: 12408 - protein, 316 aa, Artificial Sequence
  Description of Artificial Sequence: Synthetic coding sequence
MQGENFTIWSIFFLEGFSQYPGLEVVLFVFSLVMYLTTLLGNSTLILITILDSRLKTPMYLFLGNLSFMDICYTSASVPTLLVNLLSSQKTIIFSGCAVQMYLSLAMGSTECVLLAVMAYDRYVAICNPLRYSIIMNRCVCARMATVSWVTGCLTALLETSFALQIPLCGNLIDHFTCEILAVLKLACTSSLLMNTIMLVVSILLLPIPMLLVCISYIFILSTILRITSAEGRNKAFSTCGAHLTVVILYYGAALSMYLKPSSSNAQKIDKIISLLYGVLTPMLNPIIYSLRNKEVKDAMKKLLGKITLHQTHEHL

SEQ ID NO: 12409 - protein, 345 aa, Artificial Sequence
  Description of Artificial Sequence: Synthetic coding sequence
MNITLYSFLYVLRLNEGNSTGRNIDERKKMQGENFTIWSIFFLEGFSQYPGLEVVLFVFSLVMYLTTLLGNSTLILITILDSRLKTPMYLFLGNLSFMDICYTSASVPTLLVNLLSSQKTIIFSGCAVQMYLSLAMGSTECVLLAVMAYDRYVAICNPLRYSIIMNRCVCARMATVSWVTGCLTALLETSFALQIPLCGNLIDHFTCEILAVLKLACTSSLLMNTIMLVVSILLLPIPMLLVCISYIFILSTILRITSAEGRNKAFSTCGAHLTVVILYYGAALSMYLKPSSSNAQKIDKIISLLYGVLTPMLNPIIYSLRNKEVKDAMKKLLGKITLHQTHEHL

SEQ ID NO: 12410 - protein, 312 aa, Artificial Sequence
  Description of Artificial Sequence: Synthetic coding sequence
MEKWNHTSNDFILLGLLPPNQTGIFLLCLIILIFFLASVGNSAMIHLIHVDPRLHTPMYFLLSQLSLMDLMYISTTVPKMAYNFLSGQKGISFLGCGVQSFFFLTMACSEGLLLTSMAYDRYLAICHSLYYPIRMSKMMCVKMIGGSWTLGSINSLAHTVFALHIPYCRSRAIDHFFCDVPAMLLLACTDTWVYEYMVFVSTSLFLLFPFIGITSSCGRVLFAVYHMHSKEGRKKAFTTISTHLTVVIFYYAPFVYTYLRPRNLRSPAEDKILAVFYTILTPMLNPIIYSLRNKEVLGAMRRVFGIFSFLKE

SEQ ID NO: 12411 - protein, 312 aa, Artificial Sequence; identical to SEQ ID NO: 12410
  Description of Artificial Sequence: Synthetic coding sequence

SEQ ID NO: 12412 - protein, 312 aa, Artificial Sequence
  Description of Artificial Sequence: Synthetic coding sequence
MENYNQTSTDFILLGLFPQSRIGLFVFTLIFLIFLMALIGNLSMILLIFLDIHLHTPMYFLLSQLSLIDLNYISTIVPKMVYDFLYGNKSISFTGCGIQSFFFLTLAVAEGLLLTSMAYDRYVAICFPLHYPIRISKRVCVMMITGSWMISSINSCAHTVYALCIPYCKSRAINHFFCDVPAMLTLACTDTWVYESTVFLSSTIFLVLPFTGIACSYGRVLLAVYRMHSAEGRKKAYSTCSTHLTVVSFYYAPFAYTYVRPRSLRSPTEDKILAVFYTILTPMLNPIIYSLRNKEVMGALTQVIQKIFSVKM

SEQ ID NO: 12413 - protein, 312 aa, Artificial Sequence
  Description of Artificial Sequence: Synthetic coding sequence
MENYNQTSTDFILLGFFPPSRIGLFLFILIVFIFLMALIGNLSMILLIFLDTHLHTPMYFLLSQLSLIDLNYISTIVPKMASDFLSGNKSISFTGCGIQSFFFSALGGAEALLLASMAYDRYIAICFPLHYPIRMSKRMCVLMITGSWIIGSINACAHTVYVLHIPYCQSRAINHFFCDVPAMVTLACMDTWVYEGTVFLSTTIFLVFPFIAISCSYGRVLLAVYHMKSAEGRKKAYLTCSTHLTVVTFYYAPFVYTYLRPRSLRSPTEDKVLAVFYTTLTPMLNPIIYSLRNKEVMGALTRVSQRICSGKM

SEQ ID NO: 12414 - protein, 312 aa, Artificial Sequence
  Description of Artificial Sequence: Synthetic coding sequence
MENYNQTSTDFILLGLFPPSKIGLFLFILFVLIFLMALIGNLSMILLIFLDTHLHTPMYFLLSQLSLIDLNYISTIVPKMASDFLYGNKSISFIGCGIQSFFFMTFAGAEALLLTSMAYDRYVAICFPLHYPIRMSKRMYVLMITGSWMIGSINSCAHTVYAFRIPYCKSRAINHFFCDVPAMLTLACTDTWVYEYTVFLSSTIFLVFPFTGIACSYGWVLLAVYRMHSAEGRKKAYSTCSTHLTVVTFYYAPFAYTYLCPRSLRSLTEDKVLAVFYTILTPMLNPIIYSLRNKEVMGALTRVIQNIFSVKM

SEQ ID NO: 12415 - protein, 312 aa, Artificial Sequence
  Description of Artificial Sequence: Synthetic coding sequence
MENYNQTSTDFILLGLFPPSRIDLFFFILIVFIFLMALIGNLSMILLIFLDTHLHTPMYFLLSQLSLIDLNYISTIVPKMASDFLHGNKSISFTGCGIQSFFFLALGGAEALLLASMAYDRYIAICFPLHYLIRMSKRVCVLMITGSWIIGSINACAHTVYVLHIPYCRSRAINHFFCDVPAMVTLACMDTWVYEGTVFLSATIFLVFPFIGISCSYGQVLFAVYHMKSAEGRKKAYLTCSTHLTVVTFYYAPFVYTYLRPRSLRSPTEDKVLAVFYTILTPMLNPIIYSLRNKEVMGALTRVSQRICSVKM

SEQ ID NO: 12416 - protein, 347 aa, Artificial Sequence
  Description of Artificial Sequence: Synthetic coding sequence
MAWENQTFNSDFILLGIFNHSPPHTFLFFLVLGIFLVAFMGNSVMVLLIYLDTQLHTPMYFLLSQLSLMDLMLICTTVPKMAFNYLSGSKSISMAGCVTQIFFYISLSGSECFLLAVMAYDRYIAICHPLRYTNLMNPKICGLMATFSWILGSTDGIIDAVATFSFSFCGSREIAHFFCEFPSLLILSCNDTSIFEEVIFICCIVMLVFPVAIIIASYARVILAVIHMGSGEGRCKAFTTCSSHLMVVGMYYGAALFMYIRPTSDHSPTQDKMVSVFYTILTPMLNPLIYSLRNKEVTRAFMKILGKGKSESELPHKLYVLLFAKFFFLISIFFYDVKILALIMYIA

SEQ ID NO: 12417 - protein, 312 aa, Artificial Sequence
  Description of Artificial Sequence: Synthetic coding sequence
MARENSTFNSDFILLGIFNHSPTHTFLFFLVLAIFSVAFMGNSVMVLLIYLDTQLHTPMYLLLSQLSLMDLMLICTTVPKMAFNYLSGSKSISMAGCATQIFFYTSLLGSECFLLAVMAYDRYTAICHPLRYTNLMSPKICGLMTAFSWILGSTDGIIDVVATFSFSYCGSREIAHFFCDFPSLLILSCSDTSIFEKILFICCIVMIVFPVAIIIASYARVILAVIHMGSGEGRRKAFTTCSSHLLVVGMYYGAALFMYIRPTSDRSPTQDKMVSVFYTILTPMLNPLIYSLRNKEVTRAFMKILGKGKSGE

SEQ ID NO: 12418 - protein, 311 aa, Artificial Sequence
  Description of Artificial Sequence: Synthetic coding sequence
MVWENQTFNSIFILLGIFNHSPTHTFLFSLVLGIFSLALMENISMVLLIYIEKQLHTPMYFLLSQLSLMDLMLICTTLPKMIFSYLSGKKSISLAGCGTQIFFYVSLLGAECFLLAVMAYDRYVAICHPLQYTILMNPKLCVFMTVASWTLGSLDGIIVLAAVLSFSYCSSLEIHHFFCDVAALLPLSCTETSAFERLLVICCVVMLIFPVSVIILSYSHVLRAVIHMGSGESRRKAFTTCSSHLSVVGLYYGAAMFMYMRPASKHTPDQDKMVSAFYTILTPMLNPLIYSLRNKEVFRALQKVLKKRKLI

SEQ ID NO: 12419 - protein, 312 aa, Artificial Sequence
  Description of Artificial Sequence: Synthetic coding sequence
MAWENQTFNSDFILLGIFNHSPTHTFLFFLVLAIFSVAFMGNSVMVLLIYLDTQLHTPMYFLLSQLFLMDLMLICSTVPKMAFNYLSGSKSISMAGCATQIFFYVSLLGSECFLLAVMSYDRYIAICHPLRYTNLMRPKICGLMTAFSWILGSMDAIIDAVATFSFSYCGSREIAHFFCDFPSLLILSCNDTSIFEKVLFICCIVMIVFPVAIIIASYARVILAVIHMGSGEGRRKAFTTCSSHLMVVGMYYGAGLFMYIRPTSDRSPMQDKLVSVFYTILTPMLNPLIYSLRNKEVTRALRKVLGKGKCGE

SEQ ID NO: 12420 - protein, 312 aa, Artificial Sequence
  Description of Artificial Sequence: Synthetic coding sequence
MAWENQTFNSDFLLLGIFNHSPTHTFLFFLVLAIFSVAFMGNSIMVLLIYLDTQLHTPMYFLLSQLSLMDLMLICTTVPKMAFNYLSGSKSISMAGCATQIFFYISLLGSECFLLAVMSYDRYTAICHPLRYTNLMRPKICGLMTAFSWILGSTDGIIDAVATFSFSYCGSREIAHFCCDFPSLLILSCNDTSIFEEVIFICCIVMLVFPVAIIITSYARVILAVIHMGSGEGRRKAFTTCSSHLMVVGMYYGAGLFMCIQPTSHHSPMQDKMVSVFYTIVTPMLNPLIYSLRNKEVTRALMKILGKGKSGD

SEQ ID NO: 12421 - protein, 319 aa, Artificial Sequence
  Description of Artificial Sequence: Synthetic coding sequence
MEKANETSPVMGFVLLRLSAHPELEKTFFVLILLMYLVILLGNGVLILVTILDSRLHTPMYFFLGNLSFLDICFTTSSVPLVLDSFLTPQETISFSACAVQMALSFAMAGTECLLLSMMAFDRYVAICNPLRYSVIMSKAAYMPMAASSWAIGGAASVVHTSLAIQLPFCGDNVINHFTCEILAVLKLACADISINVISMEVTNVIFLGVPVLFISFSYVFIITTILRIPSAEGRKKVFSTCSAHLTVVIVFYGTLFFMYGKPKSKDSMGADKEDLSDKLIPLFYGVVTPMLNPIIYSLRNKDVKAAVRRLLRPKGFTQ

SEQ ID NO: 12422 - protein, 369 aa, Artificial Sequence
  Description of Artificial Sequence: Synthetic coding sequence
MWQEYYFLNVFFPLLKVCCLTINSHVVILLPWECYHLIWKILPYIGTTVGSMEEYNTSSTDFTFMGLFNRKETSGLIFAIISIIFFTALMANGVMIFLIQTDLRLHTPMYFLLSHLSLIDMMYISTIVPKMLVNYLLDQRTISFVGCTAQHFLYLTLVGAEFFLLGLMAYDRYVAICNPLRYPVLMSRRVCWMIIAGSWFGGSLDGFLLTPITMSFPFCNSREINHFFCEAPAVLKLACADTALYETVMYVCCVLMLLIPFSVVLASYARILTTVQCMSSVEGRKKAFATCSSHMTVVSLFYGAAMYTYMLPHSYHKPAQDKVLSVFYTILTPMLNPLIYSLRNKDVTGALKRALGRFKGPQRVSGGVF

SEQ ID NO: 12423 - protein, 312 aa, Artificial Sequence
  Description of Artificial Sequence: Synthetic coding sequence
MRLANQTLGGDFFLLGIFSQISHPGRLCLLIFSIFLMAVSWNITLILLIHIDSSLHTPMYFFINQLSLIDLTYISVTVPKMLVNQLAKDKTISVLGCGTQMYFYLQLGGAECCLLAAMAYDRYVAICHPLRYSVLMSHRVCLLLASGCWFVGSVDGFMLTPIAMSFPFCRSHEIQHFFCEVPAVLKLSCSDTSLYKIFMYLCCVIMLLIPVTVISVSYYYIILTIHKMNSVEGRKKAFTTCSSHITVVSLFYGAAIYNYMLPSSYQTPEKDMMSSFFYTILTPVLNPIIYSFRNKDVTRALKKMLSVQKPPY

SEQ ID NO: 12424 - protein, 316 aa, Artificial Sequence
  Description of Artificial Sequence: Synthetic coding sequence
MTNTSSSDFTLLGLLVNSEAAGIVFTVILAVFLGAVTANLVMIFLIQVDSRLHTPMYFLLSQLSIMDTLFICTTVPKLLADMVSKEKIISFVACGIQIFLYLTMIGSEFFLLGLMAYDCYVAVCNPLRYPVLMNRKKCLLLAAGAWFGGSLDGFLLTPITMNVPYCGSRSINHFFCEIPAVLKLACADTSLYETLMYICCVLMLLIPISIISTSYSLILLTIHRMPSAEGRKKAFTTCSSHLTVVSIFYGAAFYTYVLPQSFHTPEQDKVVSAFYTIVTPMLNPLIYSLRNKDVIGAFKKVFACCSSAQKVATSDA

SEQ ID NO: 12425 - protein, 320 aa, Artificial Sequence
  Description of Artificial Sequence: Synthetic coding sequence
MEMRNTTPDFILLGLFNHTRAHQVLFMMLLATVLTSLFSNALMILLIHWDHRLHRPMYFLLSQLSLMDMMLVSTTVPKMAADYLTGNKAISRAGCGVQIFFLPTLGGGECFLLAAMAYDRYAAVCHPLRYPTLMSWQLCLRMTMSSWLLGAADGLLQAVATLSFPYCGAHEIDHFFCEAPVLVRLACADTSVFENAMYICCVLMLLVPFSLILSSYGLILAAVLLMRSTEARKKAFATCSSHVAVVGLFYGAGIFTYMRPKSHRSTNHDKVVSAFYTMFTPLLNPLIYSVRNSEVKEALKRWLGTCVNLKHQQNEAHRSR

SEQ ID NO: 12426 - protein, 324 aa, Artificial Sequence
  Description of Artificial Sequence: Synthetic coding sequence
MGMEGLLQNSTNFVLTGLITHPAFPGLLFAIVFSIFVVAITANLVMILLIHMDSRLHTPMYFLLSQLSIMDTIYICITVPKMLQDLLSKDKTISFLGCAVQIFLYLTLIGGEFFLLGLMAYDRYVAVCNPLRYPLLMNRRVCLFMVVGSWVGGSLDGFMLTPVTMSFPFCRSREINHFFCEIPAVLKLSCTDTSLYETLMYACCVLMLLIPLSVISVSYTHILLTVHRMNSAEGRRKAFATCSSHIMVVSVFYGAAFYTNVLPHSYHTPEKDKVVSAFYTILTPMLNPLIYSLRNKDVAAALRKVLGRCGSSQSIRVATVIRKG

SEQ ID NO: 12427 - protein, 317 aa, Artificial Sequence
  Description of Artificial Sequence: Synthetic coding sequence
MEQSNYSVYADFILLGLFSNARFPWLLFALILLVFLTSIASNVVKIILIHIDSRLHTPMYFLLSQLSLRDILYISTIVPKMLVDQVMSQRAISFAGCTAQHFLYLTLAGAEFFLLGLMSYDRYVAICNPLHYPVLMSRKICWLIVAAAWLGGSIDGFLLTPVTMQFPFCASREINHFFCEVPALLKLSCTDTSAYETAMYVCCIMMLLIPFSVISGSYTRILITVYRMSEAEGRGKAVATCSSHMVVVSLFYGAAMYTYVLPHSYHTPEQDKAVSAFYTILTPMLNPLIYSLRNKDVTGALQKVVGRCVSSGKVTTF

SEQ ID NO: 12428 - protein, 315 aa, Artificial Sequence
  Description of Artificial Sequence: Synthetic coding sequence
MANITRMANHTGRLDFILMGLFRQSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTVRFVL

SEQ ID NO: 12429 - protein, 318 aa, Artificial Sequence
  Description of Artificial Sequence: Synthetic coding sequence
MCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFYLTLAGAEVFLLAAMAYDRYAAVCRPLHYPLLMNQRVCQLLVSACWVLGMVDGLLLTPITMSFPFCQSRKILSFFCETPALLKLSCSDVSLYKTLMYLCCILMLLAPIMVISSSYTLILHLIHRMNSAAGHRKALATCSSHMIIVLLLFGASFYTYMLPSSYHTAEQDMMVSAFYTIFTPVLNPLIYSLRNKDVTRALRSMMQSRMNQEK

SEQ ID NO: 12430 - protein, 320 aa, Artificial Sequence
  Description of Artificial Sequence: Synthetic coding sequence
MEMRNTTPDFILLGLFNHTRAHQVLFMMVLSIVLTSLFGNSLMILLIHWDHRLHTPMYFLLSQLSLMDMMLVSTTVPKMAADYLTGSKAISRAGCGVQIFFLPTLGGGECFLLAAMAYDRYAAVCHPLRYPTLMSWQLCLRMTMSCWLLGAADGLLQAVVTLSFPYCGAHEIDHFFCETPVLVRLACADTSVFENAMYICCVLMLLVPFSLILSSYGLILAAVLHMRSTEARKKAFATCSSHVAVVGLFYGAAIFTYMRPKSHRSTNHDKVVSAFYTMFTPLLNPLIYSVKNSEVKGALKRWLGTCVNIKHQQNEAHRSR

SEQ ID NO: 12431 - protein, 318 aa, Artificial Sequence
  Description of Artificial Sequence: Synthetic coding sequence
MCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFHLTLAGAEVFLLAAMAYDRYAAVCRPLHYPLLMNQRVCQLLVSACWVLGMVDGLLLTPITMSFPFCQSRKILSFFCETPALLKLSCSDVSLYKMLTYLCCILMLLTPIMVISSSYTLILHLIHRMNSAAGRRKALATCSSHMIIVLLLFGASFYTYMLRSSYHTAEQDMMVSAFYTIFTPVLNPLIYSLRNKDVTRALRSMMQSRMNQEK

SEQ ID NO: 12432 - protein, 323 aa, Artificial Sequence
  Description of Artificial Sequence: Synthetic coding sequence
MGMEGLLQNSTNFVLTGLITHPAFPGLLFAVVFSIFVVAITANLVMILLIHMDSRLHTPMYFLLSQLSIMDTIYICITVPKMLQDLLSKDKTISFLGCAVQIFYLTLIGGEFFLLGLMAYDRYVAVCNPLRYPLLMNRRVCLFMVVGSWVGGSLDGFMLTPVTMSFPFCRSREINHFFCEIPAVLKLSCTDTSLYETLMYACCVLMLLIPLSVISVSYTHILLTVHRMNSAEGRRKAFATCSSHIMVVSVFYGAAFYTNVLPHSYHTPEKDKVVSAFYTILTPMLNPLIYSLRNKDVAAALRKVLGRCGSSQSIRVATVIRKG

SEQ ID NO: 12433 - protein, 348 aa, Artificial Sequence
  Description of Artificial Sequence: Synthetic coding sequence
MDNITWMASHTGWSDFILMGLFRQSKHPMANITWMANHTGWSDFILLGLFRQSKHPALLCVVIFVVFLMALSGNAVLILLIHCDAHLHTPMYFFISQLSLMDMAYISVTVPKMLLDQVMGVNKISAPECGMQMFFYVTLAGSEFFLLATMAYDRYVAICHPLRYPVLMNHRVCLFLSSGCWFLGSVDGFTFTPITMTFPFRGSREIHHFFCEVPAVLNLSCSDTSLYEIFMYLCCVLMLLIPVVIISSSYLLILLTIHGMNSAEGRKKAFATCSSHLTVVILFYGAAIYTYMLPSSYHTPEKDMMVSVFYTILTPVVNPLIYSLRNKDVMGALKKMLTVEPAFQKAME

SEQ ID NO: 12434 - protein, 315 aa, Artificial Sequence
  Description of Artificial Sequence: Synthetic coding sequence
MANITRMANHTGKLDFILMGLFRRSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTVRFVL

SEQ ID NO: 12435 - protein, 308 aa, Artificial Sequence
  Description of Artificial Sequence: Synthetic coding sequence
MNENNETLTRGFTLMGLFTHNKCSGFFFGVICAVFFMAMIANGVMIFLINIDPHLHTPMYFLLSHLSVIDTLYISTIVPKMLVDYLMGEGTISFIACTAQCFLYMGFMGAEFFLLGLMAYDRYVAICNPLRYPVLISWRVCWMILASSWFGGALDSFLLTPITMSLPFCASHQINHFFCEAPTMLRLACGDKTTYETVMYVCCVAMLLIPFSVVTASYTRILITVHQMTSAEGRKKAFATCSSHMMVVTLFYGAALYTYTLPQSYHTPIKDKVFSAFYTILTPLLNPLIYSLRNRDVMGALKRVVARC

SEQ ID NO: 12436 - protein, 315 aa, Artificial Sequence
  Description of Artificial Sequence: Synthetic coding sequence
MGRWVNQSYTDGFFLLGIFSHSQTDLVLFSAVMVVFTVALCGNVLLIFLIYLDAGLHTPMYFFLSQLSLMDLMLVCNIVPKMAANFLSGRKSISFVGCGIQIGFFVSLVGSEGLLLGLMAYDRYVAVSHPLHYPILMNQRVCLQITGSSWAFGIIDGVIQMVAAMGLPYCGSRSVDHFFCEVQALLKLACADTSLFDTLLFACCVFMLLLPFSIIMASYACILGAVLRIRSAQAWKKALATCSSHLTAVTLFYGAAMFMYLRPRRYRAPSHDKVASIFYTVLTPMLNPLIYSLRNGEVMGALRKGLDRCRIGSQH

SEQ ID NO: 12437 - protein, 315 aa, Artificial Sequence
  Description of Artificial Sequence: Synthetic coding sequence
METWVNQSYTDGFFLLGIFSHSTADLVLFSVVMAVFTVALCGNVLLIFLIYMDPHLHTPMYFFLSQLSLMDLMLVCTNVPKMAANFLSGRKSISFVGCGIQIGLFVCLVGSEGLLLGLMAYDRYVAISHPLHYPILMNQRVCLQITGSSWAFGIIDGLIQMVVVMNFPYCGLRKVNHFFCEMLSLLKLACVDTSLFEKVIFACCVFMLLFPFSIIVASYAHILGTVLQMHSAQAWKKALATCSSHLTAVTLFYGAAMFIYLRPRHYRAPSHDKVASIFYTVLTPMLNPLIYSLRNREVMGALRKGLDRCRIGSQH

SEQ ID NO: 12438 - protein, 320 aa, Artificial Sequence
  Description of Artificial Sequence: Synthetic coding sequence
MDQSNYSSLHGFILLGFSNHPKMEMILSGVVAIFYLITLVGNTAIILASLLDSQLHTPMYFFLRNLSFLDLCFTTSIIPQMLVNLWGPDKTISYVGCIIQLYVYMWLGSVECLLLAVMSYDRFTAICKPLHYFVVMNPHLCLKMIIMIWSISLANSVVLCTLTLNLPTCGNNILDHFLCELPALVKIACVDTTTVEMSVFALGIIIVLTPLILILISYGYIAKAVLRTKSKASQRKAMNTCGSHLTVVSMFYGTIIYMYLQPGNRASKDQGKFLTLFYTVITPSLNPLIYTLRNKDMKDALKKLMRFHHKSTKIKRNCKS

SEQ ID NO: 12439 - protein, 320 aa, Artificial Sequence; identical to SEQ ID NO: 12438
  Description of Artificial Sequence: Synthetic coding sequence

SEQ ID NO: 12440 - protein, 320 aa, Artificial Sequence; identical to SEQ ID NO: 12438
  Description of Artificial Sequence: Synthetic coding sequence

SEQ ID NO: 12441 - protein, 320 aa, Artificial Sequence; identical to SEQ ID NO: 12438
  Description of Artificial Sequence: Synthetic coding sequence

SEQ ID NO: 12442 - protein, 320 aa, Artificial Sequence; identical to SEQ ID NO: 12438
  Description of Artificial Sequence: Synthetic coding sequence

SEQ ID NO: 12443 - protein, 320 aa, Artificial Sequence; identical to SEQ ID NO: 12438
  Description of Artificial Sequence: Synthetic coding sequence

SEQ ID NO: 12444 - protein, 320 aa, Artificial Sequence; identical to SEQ ID NO: 12438
  Description of Artificial Sequence: Synthetic coding sequence

SEQ ID NO: 12445 - protein, 320 aa, Artificial Sequence; identical to SEQ ID NO: 12438
  Description of Artificial Sequence: Synthetic coding sequence

SEQ ID NO: 12446 - protein, 314 aa, Artificial Sequence
  Description of Artificial Sequence: Synthetic coding sequence
MDGTNGSTQTHFILLGFSDRPHLERILFVVILIAYLLTLVGNTTIILVSRLDPHLHTPMYFFLAHLSFLDLSFTTSSIPQLLYNLNGCDKTISYMGCAIQLFLFLGLGGVECLLLAVMAYDRCVAICKPLHYMVIMNPRLCRGLVSVTWGCGVANSLAMSPVTLRLPRCGHHEVDHFLREMPALIRMACVSTVAIEGTVFVLAVGVVLSPLVFILLSYSYIVRAVLQIRSASGRQKAFGTCGSHLTVVSLFYGNIIYMYMQPGASSSQDQGMFLMLFYNIVTPLLNPLIYTLRNREVKGALGRLLLGKRELGKE

SEQ ID NO: 12447 - protein, 314 aa, Artificial Sequence; identical to SEQ ID NO: 12446
  Description of Artificial Sequence: Synthetic coding sequence

SEQ ID NO: 12448 - protein, 311 aa, Artificial Sequence
  Description of Artificial Sequence: Synthetic coding sequence
MGSFNTSFEDGFILVGFSDWPQLEPILFVFIFIFYSLTLFGNTIIIALSWLDLRLHTPMYFFLSHLSLLDLCFTTSTVPQLLINLCGVDRTITRGGCVAQLFIYLALGSTECVLLVVMAFDRYAAVCRPLHYMAIMHPHLCQTLAIASWGAGFVNSLIQTGLAMAMPLCGHRLNHFFCEMPVFLKLACADTEGTEAKMFVARVIVVAVPAALILGSYVHIAHAVLRVKSTAGRRKAFGTCGSHLLVVFLFYGSAIYTYLQSIHNYSEREGKFVALFYTIITPILNPLIYTLRNKDVKGALWKVLWRGRDSG

SEQ ID NO: 12449 - protein, 314 aa, Artificial Sequence
  Description of Artificial Sequence: Synthetic coding sequence
MGDVNQSVASDFILVGLFSHSGSRQLLFSLVAVMFVIGLLGNTVLLFLIRVDSRLHTPMYFLLSQLSLFDIGCPMVTIPKMASDFLRGEGATSYGGGAAQIFFLTLMGVAEGVLLVLMSYDRYVAVCQPLQYPVLMRRQVCLLMMGSSWVVGVLNASIQTSITLHFPYCASRIVDHFFCEVPALLKLSCADTCAYEMALSTSGVLILMLPLSLIATSYGHVLQAVLSMRSEEARHKAVTTCSSHITVVGLFYGAAVFMYMVPCAYHSPQQDNVVSLFYSLVTPTLNPLIYSLRNPEVWMALVKVLSRAGLRQMC

SEQ ID NO: 12450 - protein, 315 aa, Artificial Sequence
  Description of Artificial Sequence: Synthetic coding sequence
MQPESGANGTVIAEFILLGLLEAPGLQPVVFVLFLFAYLVTVRGNLSILAAVLVEPKLHTPMYFFLGNLSVLDVGCISVTVPSMLSRLLSRKRAVPCGACLTQLFFFHLFVGVDCFLLTAMAYDRFLAICRPLTYSTRMSQTVQRMLVAASWACAFTNALTHTVAMSTLNFCGPNVINHFYCDLPQLFQLSCSSTQLNELLLFAVGFIMAGTPMALIVISYIHVAAAVLRIRSVEGRKKAFSTCGSHLTVVAIFYGSGIFNYMRLGSTKLSDKDKAVGIFNTVINPMLNPIIYSFRNPDVQSAIWRMLTGRRSLA

SEQ ID NO: 12451 - protein, 321 aa, Artificial Sequence
  Description of Artificial Sequence: Synthetic coding sequence
MSLQKLMEPEAGTNRTAVAEFILLGLVQTEEMQPVVFVLLLFAYLVTTGGNLSILAAVLVEPKLHAPMYFFLGNLSVLDVGCITVTVPAMLGRLLSHKSTISYDACLSQLFFFHLLAGMDCFLLTAMAYDRLLAICQPLTYSTRMSQTVQRMLVAASLACAFTNALTHTVAMSTLNFCGPNEVNHFYCDLPQLFQLSCSSTQLNELLLFAVGFIMAGTPLVLIITAYSHVAAAVLRIRSVEGRKKAFSTCGSHLTVVCLFFGRGIFNYMRLGSEEASDKDKGVGVFNTVINPMLNPLIYSLRNPDVQGALWQIFLGRRSLT

SEQ ID NO: 12452 - protein, 321 aa, Artificial Sequence
  Description of Artificial Sequence: Synthetic coding sequence
MSLQKLMEPEAGTNRTAVAEFILLGLVQTEEMQPVVFVLLLFAYLVTTGGNLSILAAVLVEPKLHAPMYFFLGNLSVLDVGCITVTVPAMLGRLLSHKSTISYDACLSQLFFFHLLAGMDCFLLTAMAYDRLLAICQPLTYSTRMSQTVQRMLVAASWACAFTNALTHTVAMSTLNFCGPNEVNHFYCDLPQLFQLSCSSTQLNELLLFVAAAFMAVAPLVFISVSYAHVVAAVLQIRSAEGRKKAFSTCGSHLTVVGIFYGTGVFSYMRLGSVESSDKDKGVGVFMTVINPMLNPLIYSLRNTDVQGALCQLLVGKRSLT

SEQ ID NO: 12453 - protein, 344 aa, Artificial Sequence
  Description of Artificial Sequence: Synthetic coding sequence
MELLTNNLKFITDPFVCRLRHLSPTPSEEHMKNKNNVTEFILLGLTQNPEGQKVLFVTFLLIYMVTIMGNLLIIVTIMASQSLGSPMYFFLASLSFIDTVYSTAFAPKMIVDLLSEKKTISFQGCMAQLFMDHLFAGAEVILLVVMAYDRYMAICKPLHELITMNRRVCVLMLLAAWIGGFLHSLVQFLFIYQLPFCGPNVIDNFLCDLYPLLKLACTNTYVTGLSMIANGGAICAVTFFTILLSYGVILHSLKTQSLEGKRKAFYTCASHVTVVILFFVPCIFLYARPNSTFPIDKSMTVVLTFITPMLNPLIYTLKNAEMKSAMRKLWSKKVSLAGKWLYHS

SEQ ID NO: 12454 - protein, 328 aa, Artificial Sequence
  Description of Artificial Sequence: Synthetic coding sequence
MRPSSNVTEFVLLGLTQDPDVKKTLFVMFLLIYIVTMVGNLLIWVTTIGSPSLGSLMYFFLAYLSLMDAIYSTAMSPKLMIDLLCDKIAISLSACMGQLFIEHLLGGAEVFLLVVMAYDRYVAISKPLHYLNIMNRLVCILLLVVAMIGGFVHSVVQIVFLYSLPICGPNVIDHSVCDMYPLLELLCLDTYFIGLTVVANGGIICMVIFTFLLISCGVILNFLKTYSQEERHKALPTCISHIIVVALVFVPCIFMYVRPVSNFPFDKLMTVFYSIITLMLNPLIYSLRQSEMKNAMKNLWCEKLSIVRKRVSPTLNIFIPSSKATNRR

SEQ ID NO: 12455 - protein, 309 aa, Artificial Sequence
  Description of Artificial Sequence: Synthetic coding sequence
MEPRKNVTDFVLLGFTQNPKEQKVLFVMFLLFYILTMVGNLLIVVTVTVSETLGSPMYFFLAGLSFIDIIYSSSISPRLISGLFFGNNSISFQSCMAQLFIEHIFGGSEVFLLLVMAYDCYVAICKPLHYLVIMRQWVCVVLLVVSWVGGFLHSVFQLSIIYGLPFCGPNVIDHFFCDMYPLLKLVCTDTHAIGLLVVANGGLACTIVFLLLLISYGVILHSLKNLSQKGRQKALSTCSSHMTVVVFFFVPCIFMYARPARTFPIDKSVSVFYTVITPMLNPLIYTLRNSEMTSAMKKLWRRDLISSST

SEQ ID NO: 12456 - protein, 315 aa, Artificial Sequence
  Description of Artificial Sequence: Synthetic coding sequence
MRQNNNITEFVLLGFSQDPGVQKALFVMFLLTYLVTVVGNLLIVVDIIASPSLGSPMYFFLACLSFIDAAYSTTISPKLIVGLFCDKKTISFQGCMGQLFIDHFFGGAEVFLLVVMACDRYVAICKPLHYLTIMNRQVCFLLLVVAMIGGFVHSAFQIVVYSLPFCGPNVIVHFSCDMHPLLELACTDTYFIGLTVVVNSGAICMVIFNLLLISYGVILSSLKTYSQEKRGKALSTCSSGSTVVVLFFVPCIFIYVRPVSNFPTDKFMTVFYTIITHMLSPLIYTLRNSEMRNAIEKLLGKKLTIFIIGGVSVLM

SEQ ID NO: 12457 - protein, 309 aa, Artificial Sequence
  Description of Artificial Sequence: Synthetic coding sequence
MASTSNVTELIFTGLFQDPAVQSVCFVVFLPVYLATVVGNGLIVLTVSISKSLDSPMYFFLSCLSLVEISYSSTIAPKFIIDLLAKIKTISLEGCLTQIFFFHFFGVAEILLIVVMAYDCYVAICKPLHYMNIISRQLCHLLVAGSWLGGFCHSIIQILVIIQLPFCGPNVIDHYFCDLQPLFKLACTDTFMEGVIVLANSGLFSVFSFLILVSSYIVILVNLRNHSAEGRHKALSTCASHITVVILFFGPAIFLYMRPSSTFTEDKLVAVFYTVITPMLNPIIYTLRNAEVKIAIRRLWSKKENPGRE

SEQ ID NO: 12458 - protein, 310 aa, Artificial Sequence
  Description of Artificial Sequence: Synthetic coding sequence
MQQNNSVPEFILLGLTQDPLRQKIVFVIFLIFYMGTVVGNMLIIVTIKSSRTLGSPMYFFLFYLSFADSCFSTSTAPRLIVDALSEKKIITYNECMTQVFALHLFGCMEIFVLILMAVDRYVAICKPLRYPTIMSQQVCIILIVLAWIGSLIHSTAQIILALRLPFCGPYLIDHYCCDLQPLLKLACMDTYMINLLLVSNSGAICSSSFMILIISYIVILHSLRNHSAKGKKKALSACTSHIIVVILFFGPCIFIYTRPPTTFPMDKMVAVFYTIGTPFLNPLIYTLRNAEVKNAMRKLWHGKIISENKG

SEQ ID NO: 12459 - protein, 309 aa, Artificial Sequence
  Description of Artificial Sequence: Synthetic coding sequence
MEKKKNVTEFILIGLTQNPIMEKVTFVVFLVLYMITLSGNLLIVVTITTSQALSSPMYFFLTHLSLIDTVYSSSSAPKLIVDSFQEKKIISFNGCMAQAYAEHIFGATEIILLTVMACDCYVAICKPLNYTTIMSHSLCILLVAVAWVGGFLHATIQILFTVWLPFCGPNVIGHFMCDLYPLLKLVCIDTHTLGLFVAVNSGFICLLNFLILVVSYVIILRSLKNNSLEGRCKALSTCISHIIVVVLFFVPCIFVYLRSVTTLPIDKAVAVFYTMVVPMLNPVVYTLRNAEVKSAIRKLWRKKVTSDND

SEQ ID NO: 12460 - protein, 309 aa, Artificial Sequence
  Description of Artificial Sequence: Synthetic coding sequence
MANRNNVTEFILLGLTENPKMQKIIFVVFSVIYINAMIGNVLIVVTITASPSLRSPMYFFLAYLSFIDACYSSVNTPKLITDSLYENKTILFNGCMTQVFGEHFFRGVEVILLTVMAYDHYVAICKPLHYTTVMKQHVCSLLVGVSWVGGFLHATIQILFICQLPFCGPNVIDHFMCDLYTLINLACTNTHTLGLFIAANSGFICLLNCLLLLVSCVVILYSLKTHSLEARHEALSTCVSHITVVILSFIPCIFVYMRPPATLPIDKAVAVFYTMITSMLNPLIYTLRNAQMKNAIRKLCSRKAISSVK

SEQ ID NO: 12461 - protein, 370 aa, Artificial Sequence
  Description of Artificial Sequence: Synthetic coding sequence
MFSMTTEALNNFALGCTNLLMTMIPQIDLKQIFLCPNCRLYMIPVGAFIFSLGNMQNQSFVTEFVLLGLSQNPNVQEIVFVVFLFVYIATVGGNMLIVVTILSSPALLVSPMYFFLGFLSFLDACFSSVITPKMIVDSLYVTKTISFEGCMMQLFAEHFFAGVEVIVLTAMAYDRYVAICKPLHYSSIMNRRLCGILMGVAWTGGLLHSMIQILFTFQLPFCGPNVINHFMCDLYPLLELACTDTHIFGLMVVINSGFICIINFSLLLVSYAVILLSLRTHSSEGRWKALSTCGSHIAVVILFFVPCIFVYTRPPSAFSLDKMAAIFYIILNPLLNPLIYTFRNKEVKQAMRRIWNRLMVVSDEKENIKL

SEQ ID NO: 12462 - protein, 310 aa, Artificial Sequence
  Description of Artificial Sequence: Synthetic coding sequence
MQLNNNVTEFILLGLTQDPFWKKIVFVIFLRLYLGTLLGNLLIIISVKTSQALKNPMFFFLFYLSLSDTCLSTSITPRMIVDALLKKTTISFSECMIQVFSSHVFGCLEIFILILTAVDRYVDICKPLHYMTIISQWVCGVLMAVAWVGSCVHSLVQIFLALSLPFCGPNVINHCFCDLQPLLKQACSETYVVNLLLVSNSGAICAVSYVMLIFSYVIFLHSLRNHSAEVIKKALSTCVSHIIVVILFFGPCIFMYTCLATVFPMDKMIAVFYTVGTSFLNPVIYTLKNTEVKSAMRKLWSKKLITDDKR

SEQ ID NO: 12463 - protein, 329 aa, Artificial Sequence
  Description of Artificial Sequence: Synthetic coding sequence
MQLVLLLMFLLVFIGNTAPAFSVTLESMDIPQNITEFFMLGLSQNSEVQRVLFVVFLLIYVVTVCGNMLIVVTITSSPTLASPVYFFLANLSFIDTFYSSSMAPKLIADSLYEGRTISYECCMAQLFGAHFLGGVEIILLTVMAYDRYVAICKPLHNTTIMTRHLCAMLVGVAWLGGFLHSLVQLLLVLWLPFCGPNVINHFACDLYPLLEVACTNTYVIGLLVVANSGLICLLNFLMLAASYIVILYSLRSHSADGRCKALSTCGAHFIVVALFFVPCIFTYVHPFSTLPIDKNMALFYGILTPMLNPLIYTLRNEEVKNAMRKLFTW

SEQ ID NO: 12464 - protein, 200 aa, Artificial Sequence
  Description of Artificial Sequence: Synthetic coding sequence
ILLTVMAYDRYVAICKPLHNTTIMTRHLCAMLVGVAWLGGFLHSLVQLLLVLWLPFCGPNVINHFACDLYPLLEVACTNTYVIGLLVVANSGLICLLNFLMLAASYIVILYSLRSHSADGRCKALSTCGAHFIVVALFFVPCIFTYVHPFSTLPIDKNMALFYGILTPMLNPLIYTLRNEEVKNNTIKHFWKHILEEDKT

SEQ ID NO: 12465 - protein, 326 aa, Artificial Sequence
  Description of Artificial Sequence: Synthetic coding sequence
MYVSNCNPCAIHRKINYPNTKLDFEQVNNITEFILLGLTQNAEAQKLLFAVFTLIYFLTMVDNLIIVVTITTSPALDSPVYFFLSFFSFIDGCSSSTMAPKMIFDLLTEKKTISFSGCMTQLFVEHFFGGVEIILLVVMAYDCYVAICKPLYYLITMNRQVCGLLVAMAWVGGFLHALIQMLLIVWLPFCGPNVIDHFICDLFPLLKLSCTDTHVFGLFVAANSGLMCMLIFSILITSYVLILCSQRKALSTCAFHITVVVLFFVPCILVYLRPMITFPIDKAVSVFYTVVTPMLNPLIYTLRNTEVKNAMKQLWSQIIWGNNLCD

SEQ ID NO: 12466 - protein, 309 aa, Artificial Sequence
  Description of Artificial Sequence: Synthetic coding sequence
MENQNNVTEFILLGLTENLELWKIFSAVFLVMYVATVLENLLIVVTIITSQSLRSPMYFFLTFLSLLDVMFSSVVAPKVIVDTLSKSTTISLKGCLTQLFVEHFFGGVGIILLTVMAYDRYVAICKPLHYTIIMSPRVCCLMVGGAWVGGFMHAMIQLLFMYQIPFCGPNIIDHFICDLFQLLTLACTDTHILGLLVTLNSGMMCVAIFLILIASYTVILCSLKSYSSKGRHKALSTCSSHLTVVVLFFVPCIFLYMRPVVTHPIDKAMAVSDSIITPMLNPLIYTLRNAEVKSAMKKLWMKWEALAGK

SEQ ID NO: 12467 - protein, 310 aa, Artificial Sequence
  Description of Artificial Sequence: Synthetic coding sequence
MEPQNTTQVSMFVLLGFSQTQELQKFLFLLFLLVYVTTIVGNLLIMVTVTFDCRLHTPMYFLLRNLALIDLCYSTVTSPKMLVDFLHETKTISYQGCMAQIFFFHLLGGGTVFFLSVMAYDRYIAISQPLRYVTIMNTQLCVGLVVAAWVGGFVHSIVQLALILPLPFCGPNILDNFYCDVPQVLRLACTDTSLLEFLMISNSGLLVIIWFLLLLISYTVILVMLRSHSGKARRKAASTCTTHIIVVSMIFIPCIYIYTWPFTPFLMDKAVSISYTVMTPMLNPMIYTLRNQDMKAAMRRLGKCLVICRE

SEQ ID NO: 12468 - protein, 311 aa, Artificial Sequence
  Description of Artificial Sequence: Synthetic coding sequence
MEMENCTRVKEFIFLGLTQNREVSLVLFLFLLLVYVTTLLGNLLIMVTVTCESRLHTPMYFLLHNLSIADICFSSITVPKVLVDLLSERKTISFNHCFTQMFLFHLIGGVDVFSLSVMALDRYVAISKPLHYATIMSRDHCIGLTVAAWLGGFVHSIVQISLLLPLPFCGPNVLDTFYCDVHRVLKLAHTDIFILELLMISNNGLLTTLWFFLLLVSYIVILSLPKSQAGEGRRKAISTCTSHITVVTLHFVPCIYVYARPFTALPMDKAISVTFTVISPLLNPLIYTLRNHEMKSAMRRLKRRLVPSDRK

SEQ ID NO: 12469 - protein, 311 aa, Artificial Sequence
  Description of Artificial Sequence: Synthetic coding sequence
MELGNVTRVKEFIFLGLTQSQDQSLVLFLFLCLVYMTTLLGNLLIMVTVTCESRLHTPMYFLLRNLAILDICFSSTTAPKVLLDLLSKKKTISYTSCMTQIFLFHLLGGADIFSLSVMAFDCYMAISKPLHYVTIMSRGQCTALISASWMGGFVHSIVQISLLLPLPFCGPNVLDTFYCDVPQVLKLTCTDTFALEFLMISNNGLVTTLWFIFLLVSYTVILMTLRSQAGGGRRKAISTCTSHITVVTLHFVPCIYVYARPFTALPTEKAISVTFTVISPLLNPLIYTLRNQEMKSAMRRLKRRLVPSERE

SEQ ID NO: 12470 - protein, 307 aa, Artificial Sequence
  Description of Artificial Sequence: Synthetic coding sequence
METGNLTWVSDFVFLGLSQTRELQRFLFLMFLFVYITTVMGNILIIITVTSDSQLHTPMYFLLRNLAVLDLCFSSVTAPKMLVDLLSEKKTISYQGCMGQIFFFHFLGGAMVFFLSVMAFDRLIAISRPLRYVTVMNTQLWVGLVVATWVGGFVHSIVQLALMLPLPFCGPNILDNFYCDVPQVLRLACTDTSLLEFLKISNSGLLDVVWFFLLLMSYLFILVMLRSHPGEARRKAASTCTTHIIVVSMIFVPSIYLYARPFTPFPMDKLVSIGHTVMTPMLNPMIYTLRNQDMQAAVRRLGRHRLV

SEQ ID NO: 12471 - protein, 318 aa, Artificial Sequence
  Description of Artificial Sequence: Synthetic coding sequence
MNPANHSQVAGFVLLGLSQVWELRFVFFTVFSAVYFMTVVGNLLIVVIVTSDPHLHTTMYFLLGNLSFLDFCYSSITAPRMLVDLLSGNPTISFGGCLTQLFFFHFIGGIKIFLLTVMAYDRYIAISQPLHYTLIMNQTVCALLMAASWVGGFIHSIVQIALTIQLPFCGPDKLDNFYCDVPQLIKLACTDTFVLELLMVSNNGLVTLMCFLVLLGSYTALLVMLRSHSREGRSKALSTCASHIAVVTLIFVPCIYVYTRPFRTFPMDKAVSVLYTIVTPMLNPAIYTLRNKEVIMAMKKLWRRKKDPIGPLEHRPLH

SEQ ID NO: 12472 - protein, 314 aa, Artificial Sequence
  Description of Artificial Sequence: Synthetic coding sequence
MDQINHTNVKEFFFLELTRSRELEFFLFVVFFAVYVATVLGNALIVVTITCESRLHTPMYFLLRNKSVLDIVFSSITVPKFLVDLLSDRKTISYNDCMAQIFFFHFAGGADIFFLSVMAYDRYLAIAKPLHYVTMMRKEVWVALVVASWVSGGLHSIIQVILMLPFPFCGPNTLDAFYCYVLQVVKLACTDTFALELFMISNNGLVTLLWFLLLLGSYTVILVMLRSHSGEGRNKALSTCTSHMLVVTLHFVPCVYIYCRPFMTLPMDTTISINNTVITPMLNPIIYSLRNQEMKSAMQRLQRRLGPSESRKWG

SEQ ID NO: 12473 - protein, 314 aa, Artificial Sequence
  Description of Artificial Sequence: Synthetic coding sequence
MDQRNYTRVKEFTFLGITQSRELSQVLFTFLFLVYMTTLMGNFLIMVTVTCESHLHTPMYFLLRNLSILDICFSSITAPKVLIDLLSETKTISFSGCVTQMFFFHLLGGADVFSLSVMAFDRYIAISKPLHYMTIMSRGRCTGLIVASWVGGFVHSIAQISLLLPLPFCGPNVLDTFYCDVPQVLKLACTDTFTLELLMISNNGLVSWFVFFFLLISYTVILMMLRSHTGEGRRKAISTCTSHITVVTLHFVPCIYVYARPFTALPTDTAISVTFTVISPLLNPIIYTLRNQEMKLAMRKLKRRLGQSERILIQ

SEQ ID NO: 12474 - protein, 313 aa, Artificial Sequence
  Description of Artificial Sequence: Synthetic coding sequence
MDSLNQTRVTEFVFLGLTDNRVLEMLFFMAFSAIYMLTLSGNILIIIATVFTPSLHTPMYFFLSNLSFIDICHSSVTVPKMLEGLLLERKTISFDNCITQLFFLHLFACAEIFLLIIVAYDRYVAICTPLHYPNVMNMRVCIQLVFALWLGGTVHSLGQTFLTIRLPYCGPNIIDSYFCDVPLVIKLACTDTYLTGILIVTNSGTISLSCFLAVVTSYMVILVSLRKHSAEGRQKALSTCSAHFMVVALFFGPCIFIYTRPDTSFSIDKVVSVFYTVVTPLLNPFIYTLRNEEVKSAMKQLRQRQVFFTKSYT

SEQ ID NO: 12475 - protein, 312 aa, Artificial Sequence
  Description of Artificial Sequence: Synthetic coding sequence
MNGMNHSVVSEFVFMGLTNSREIQLLLFVFSLLFYFASMMGNLVIVFTVTMDAHLHSPMYFLLANLSIIDMAFCSITAPKMICDIFKKHKAISFRGCITQIFFSHALGGTEMVLLIAMAFDRYMAICKPLHYLTIMSPRMCLYFLATSSIIGLIHSLVQLVFVVDLPFCGPNIFDSFYCDLPRLLRLACTNTQELEFMVTVNSGLISVGSFVLLVISYIFILFTVWKHSSGGLAKALSTLSAHVTVVILFFGPLMFFYTWPSPTSHLDKYLAIFDAFITPFLNPVIYTFRNKDMKVAMRRLCSRLAHFTKIL

SEQ ID NO: 12476 - protein, 312 aa, Artificial Sequence
  Description of Artificial Sequence: Synthetic coding sequence
MDGENHSVVSEFLFLGLTHSWEIQLLLLVFSSVLYVASITGNILIVFSVTTDPHLHSPMYFLLASLSFIDLGACSVTSPKMIYDLFRKRKVISFGGCIAQIFFIHVVGGVEMVLLIAMAFDRYVALCKPLHYLTIMSPRMCLSFLAVAWTLGVSHSLFQLAFLVNLAFCGPNVLDSFYCDLPRLLRLACTDTYRLQFMVTVNSGFICVGTFFILLISYVFILFTVWKHSSGGSSKALSTLSAHSTVVLLFFGPPMFVYTRPHPNSQMDKFLAIFDAVLTPFLNPVVYTFRNKEMKAAIKRVCKQLVIYKRIS

SEQ ID NO: 12477 - protein, 305 aa, Artificial Sequence
  Description of Artificial Sequence: Synthetic coding sequence
MVTEFIFLGLSDSQGLQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVAWGIGFLHSVSQLAFAVHLPFCGPNEVDSFYCDLPRVIKLACTDTYRLDIMVIANSGVLTVCSFVLLIISYTIILMTIQHRPLDKSSKALSTLTAHITVVLLFFGPCVFIYAWPFPIKSLDKFLAVFYSVITPLLNPIIYTLRNKDMKTAIRQLRKWDAHSSVKF

SEQ ID NO: 12478 - protein, 294 aa, Artificial Sequence
  Description of Artificial Sequence: Synthetic coding sequence
SPGPVFSYPPPSLLFIIPVKLGLEHFFHIKVTAEAISWNESTSETNNSMVTEFIFLGLSDSQGLQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVAWGIGFLHSVSQLAFAVHLPFCGPNEVDSFYCDLPRVIKLACTDTYRLDIMVIANSGVLTVCSFVLLIISYTIILMTIQHRPLDKSSKALSTLTAHITVVLLFFGP

SEQ ID NO: 12479 - protein, 312 aa, Artificial Sequence
  Description of Artificial Sequence: Synthetic coding sequence
MDGENHSVVSEFLFLGLTHSWEIQLLLLVFSSVLYVASITGNIFIVFSVTTDPHLHSPMYFLLASLSFIDLGACSVTSPKMIYDLFRKRKVISFGGCIAQIFFIHVIGGVEMVLLIAMAFDRYVALCKPLHYLTIMSPRMCLSFLAVAWTLGVSHSLFQLAFLVNLAFCGPNVLDSFYCDLPRLLRLACTDTYRLQFMVTVNSGFICVGTFFILLISYVFILFTVWKHSSGGSSKALSTLSAHSTVVLLFFGPPMFVYTRPHPNSQMDKFLAIFDAVLTPFLNPVVYTFRNKEMKAAIKRVCKQLVIYKKIS

SEQ ID NO: 12480 - protein, 312 aa, Artificial Sequence; identical to SEQ ID NO: 12476
  Description of Artificial Sequence: Synthetic coding sequence

SEQ ID NO: 12481 - protein, 312 aa, Artificial Sequence; identical to SEQ ID NO: 12476
  Description of Artificial Sequence: Synthetic coding sequence

SEQ ID NO: 12482 - protein, 305 aa, Artificial Sequence
  Description of Artificial Sequence: Synthetic coding sequence
MVTEFIFLGLSDSQELQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVAWGIGFLHSVSQLAFAVHLPFCGPNEVDSFYCDLPRVIKLACTDTYRLDIMVIANSGVLTVCSFVLLIISYTIILMTIQHCPLDKSSKALSTLTAHITVVLLFFGPCVFIYAWPFPIKSLDKFLAVFYSVITPLLNPIIYTLRNKDMKTAIRRLRKWDAHSSVKF

SEQ ID NO: 12483 - protein, 305 aa, Artificial Sequence
  Description of Artificial Sequence: Synthetic coding sequence
MVTEFIFLGLSDSQELQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVTWGIGFLHSVSQLAFAVHLLFCGPNEVDSFYCDLPRVIKLACTDTYRLDIMVIANSGVLTVCSFVLLIISYTIILMTIQHRPLDKSSKALSTLTAHITVVLLFFGPCVFIYAWPFPIKSLDKFLAVFYSVITPLLNPIIYTLRNKDMKTAIRQLRKWDAHSSVKF

SEQ ID NO: 12484 - protein, 312 aa, Artificial Sequence
  Description of Artificial Sequence: Synthetic coding sequence
MDEANHSVVSEFVFLGLSDSRKIQLLLFLFFSVFYVSSLMGNLLIVLTVTSDPRLQSPMYFLLANLSIINLVFCSSTAPKMIYDLFRKHKTISFGGCVVQIFFIHAVGGTEMVLLIAMAFDRYVAICKPLHYLTIMNPQRCILFLVISWIIGIIHSVIQLAFVVDLLFCGPNELDSFFCDLPRFIKLACIETYTLGFMVTANSGFISLASFLILIISYIFILVTVQKKSSGGIFKAFSMLSAHVIVVVLVFGPLIFFYIFPFPTSHLDKFLAIFDAVITPVLNPVIYTFRNKEMMVAMRRRCSQFVNYSKIF

SEQ ID NO: 12485 - protein, 311 aa, Artificial Sequence
  Description of Artificial Sequence: Synthetic coding sequence
MAHTNESMVSEFVLLGLSNSWGLQLFFFAIFSIVYVTSVLGNVLIIVIISFDSHLNSPMYFLLSNLSFIDICQSNFATPKMLVDFFIERKTISFEGCMAQIFVLHSFVGSEMMLLVAMAYDRFIAICKPLHYSTIMNRRLCVIFVSISWAVGVLHSVSHLAFTVDLPFCGPNEVDSFFCDLPLVIELACMDTYEMEIMTLTNSGLISLSCFLALIISYTIILIGVRCRSSSGSSKALSTLTAHITVVILFFGPCIYFYIWPFSRLPVDKFLSVFYTVCTPLLNPIIYSLRNEDVKAAMWKLRNRHVNSWKN

SEQ ID NO: 12486 - protein, 304 aa, Artificial Sequence
  Description of Artificial Sequence: Synthetic coding sequence
MERANHSVVSEFILLGLSKSQNLQILFFLGFSVVFVGIVLGNLLILVTVTFDSLLHTPMYFLLSNLSCIDMILASFATPKMIVDFLRERKTISWWGCYSQMFFMHLLGGSEMMLLVAMAIDRYVAICKPLHYMTIMSPRVLTGLLLSSYAVGFVHSSSQMAFMLTLPFCGPNVIDSFFCDLPLVIKLACKDTYILQLLVIADSGLLSLVCFLLLLVSYGVIIFSVRYRAASRSSKAFSTLSAHITVVTLFFAPCVFIYVWPFSRYSVDKILSVFYTIFTPLLNPIIYTLRNQEVKAAIKKRLCI

SEQ ID NO: 12487 - protein, 310 aa, Artificial Sequence
  Description of Artificial Sequence: Synthetic coding sequence
MDPQNYSLVSEFVLHGLCTSRHLQNFFFIFFFGVYVAIMLGNLLILVTVISDPCLHSSPMYFLLGNLAFLDMWLASFATPKMIRDFLSDQKLISFGGCMAQIFFLHFTGGAEMVLLVSMAYDRYVAICKPLHYMTLMSWQTCIRLVLASWVVGFVHSISQVAFTVNLPYCGPNEVDSFFCDLPLVIKLACMDTYVLGIIMISDSGLLSLSCFLLLLISYTVILLAIRQRAAGSTSKALSTCSAHIMVVTLFFGPCIFVYVRPFSRFSVDKLLSVFYTIFTPLLNPIIYTLRNEEMKAAMKKLQNRRVTFQ

SEQ ID NO: 12488 - protein, 348 aa, Artificial Sequence
  Description of Artificial Sequence: Synthetic coding sequence
MLTSLTDLCFSPIQVAEIKSLPKSMNETNHSRVTEFVLLGLSSSRELQPFLFLTFSLLYLAILLGNFLIILTVTSDSRLHTPMYFLLANLSFIDVCVASFATPKMIADFLVERKTISFDACLAQIFFVHLFTGSEMVLLVSMAYDRYVAICKPLHYMTVMSRRVCVVLVLISWFVGFIHTTSQLAFTVNLPFCGPNKVDSFFCDLPLVTKLACIDTYVVSLLIVADSGFLSLSSFLLLVVSYTVILVTVRNRSSASMAKARSTLTAHITVVTLFFGPCIFIYVWPFSSYSVDKVLAVFYTIFTLILNPVIYTLRNKEVKAAMSKLKSRYLKPSQVSVVIRNVLFLETK

SEQ ID NO: 12489 - protein, 343 aa, Artificial Sequence
  Description of Artificial Sequence: Synthetic coding sequence
MALYFSLILHGMSDLFFLSTGHPRASCRMEAMKLLNQSQVSEFILLGLTSSQDVEFLLFALFSVIYVVTVLGNLLIIVTVFNTPNLNTPMYFLLGNLSFVDMTLASFATPKVILNLLKKQKVISFAGCFTQIFLLHLLGGVEMVLLVSMAFDRYVAICKPLHYMTIMNKKVCVLLVVTSWLLGLLHSGFQIPFAVNLPFCGPNVVDSIFCDLPLVTKLACIDIYFVQVVIVANSGIISLSCFIILLISYSLILITIKNHSPTGQSKARSTLTAHITVVILFFGPCIFIYIWPFGNHSVDKFLAVFYTIITPILNPIIYTLRNKEMKISMKKLWRAFVNSREDT

SEQ ID NO: 12490 - protein, 314 aa, Artificial Sequence
  Description of Artificial Sequence: Synthetic coding sequence
MDVGNKSTMSEFVLLGLSNSWELQMFFFMVFSLLYVATMVGNSLIVITVIVDPHLHSPMYFLLTNLSIIDMSLASFATPKMITDYLTGHKTISFDGCLTQIFFLHLFTGTEIILLMAMSFDRYIAICKPLHYASVISPQVCVALVVASWIMGVMHSMSQVIFALTLPFCGPYEVDSFFCDLPVVFQLACVDTYVLGLFMISTSGIIALSCFIVLFNSYVIVLVTVKHHSSRGSSKALSTCTAHFIVVFLFFGPCIFIYMWPLSSFLTDKILSVFYTIFTPTLNPIIYTLRNQEVKIAMRKLKNRFLNFNKAMPS

SEQ ID NO: 12491 - protein, 323 aa, Artificial Sequence
  Description of Artificial Sequence: Synthetic coding sequence
MDKSNSSVVSEFVLLGLCSSQKLQLFYFCFFSVLYTVIVLGNLLIILTVTSDTSLHSPMYFLLGNLSFVDICQASFATPKMIADFLSAHETISFSGCIAQIFFIHLFTGGEMVLLVSMAYDRYVAICKPLYYVVIMSRRTCTVLVMISWAVSLVHTLSQLSFTVNLPFCGPNVVDSFFCDLPRVTKLACLDSYIIEILIVVNSGILSLSTFSLLVSSYIIILVTVWLKSSAAMAKAFSTLASHIAVVILFFGPCIFIYVWPFTISPLDKFLAIFYTVFTPVLNPIIYTLRNRDMKAAVRKIVNHYLRPRRISEMSLVVRTSFH

SEQ ID NO: 12492 - protein, 312 aa, Artificial Sequence
  Description of Artificial Sequence: Synthetic coding sequence
MDLKNGSLVTEFILLGFFGRWELQIFFFVTFSLIYGATVMGNILIMVTVTCRSTLHSPLYFLLGNLSFLDMCLSTATTPKMIIDLLTDHKTISVWGCVTQMFFMHFFGGAEMTLLIIMAFDRYVAICKPLHYRTIMSHKLLKGFAILSWIIGFLHSISQIVLTMNLPFCGHNVINNIFCDLPLVIKLACIETYTLELFVIADSGLLSFTCFILLLVSYIVILVSVPKKSSHGLSKALSTLSAHIIVVTLFFGPCIFIYVWPFSSLASNKTLAVFYTVITPLLNPSIYTLRNKKMQEAIRKLRFQYVSSAQNF

SEQ ID NO: 12493 - protein, 313 aa, Artificial Sequence
  Description of Artificial Sequence: Synthetic coding sequence
METANYTKVTEFVLTGLSQTREVQLVLFVIFLSFYLFILPGNILIICTIRLDPHLTSPMYFLLANLALLDIWYSSITAPKMLIDFFVERKIISFGGCIAQLFFLHFVGASEMFLLTVMAYDRYAAICRPLHYATIMNRRLCCILVALSWMGGFIHSIIQVALIVRLPFCGPNELDSYFCDITQVVRIACANTFPEELVMICSSGLISVVCFIALLMSYAFLLALLKKHSGSGENTNRAMSTCYSHITIVVLMFGPSIYIYARPFDSFSLDKVVSVFHTVIFPLLNPIIYTLRNKEVKAAMRKVVTKYILCEEK

SEQ ID NO: 12494 - protein, 313 aa, Artificial Sequence
  Description of Artificial Sequence: Synthetic coding sequence
METANYTKVTEFVLTGLSQTPEVQLVLFVIFLSFYLFILPGNILIICTISLDPHLTSPMYFLLANLAFLDIWYSSITAPEMLIDFFVERKIISFDGCIAQLFFLHFAGASEMFLLTVMAFDLYTAICRPLHYATIMNQRLCCILVALSWRGGFIHSIIQVALIVRLPFCGPNELDSYFCDITQVVRIACANTFPEELVMICSSGLISVVCLIALLMSYAFLLALFKKLSGSGENTNRAMSTCYSHITIVVLMFGPSIYIYARPFDSFSLDKVVSVFNTLIFPLRNPIIYTLRNKEVKAAMRKLVTKYILCKEK

SEQ ID NO: 12495 - protein, 307 aa, Artificial Sequence
  Description of Artificial Sequence: Synthetic coding sequence
MESENRTVIREFILLGLTQSQDIQLLVFVLVLIFYFIILPGNFLIIFTIKSDPGLTAPLYFFLGNLAFLDASYSFIVAPRMLVDFLSAKKIISYRGCITQLFFLHFLGGGEGLLLVVMAFDRYIAICRPLHYPTVMNPRTCYAMMLALWLGGFVHSIIQVVLILRLPFCGPNQLDNFFCDVPQVIKLACTDTFVVELLMVFNSGLMTLLCFLGLLASYAVILCRIRGSSSEAKNKAMSTCITHIIVIFFMFGPGIFIYTRPFRAFPADKVVSLFHTVIFPLLNPVIYTLRNQEVKASMKKVFNKHIA

SEQ ID NO: 12496 - protein, 21 aa, Artificial Sequence
  Description of Artificial Sequence: Synthetic coding sequence
MESENRTVIREFILLGLTQSQ

SEQ ID NO: 12497 - protein, 146 aa, Artificial Sequence
  Description of Artificial Sequence: Synthetic coding sequence
MESENRTVIREFILLGLTQSQDIQLLVFVLVLIFYFIILPGNFLIIFTIKSDPGLTAPLYFFLGNLAFLDASYSFIVAPRMLVDFLSAKKIISYRGCITQLFFLHFLGGGEGLLLVVMAFDRYIAICRPLHYPTVMNPRTCYAMML

SEQ ID NO: 12498 - protein, 316 aa, Artificial Sequence
  Description of Artificial Sequence: Synthetic coding sequence
MKIANNTVVTEFILLGLTQSQDIQLLVFVLILIFYLIILPGNFLIIFTIRSDPGLTAPLYLFLGNLAFLDASYSFIVAPRMLVDFLSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSTCTTRVIIILLMFGPAIFIYMCPFRALPADKMVSLFHTVIFPLMNPMIYTLRNQEVKTSMKRLLSRHVVCQVDFIIRN

SEQ ID NO: 12499 - protein, 308 aa, Artificial Sequence
  Description of Artificial Sequence: Synthetic coding sequence
METQNLTVVTEFILLGLTQSQDAQLLVFVLVLIFYLIILPGNFLIIFTIKSDPGLTAPLYFFLGNLALLDASYSFIVVPRMLVDFLSEKKVISYRSCITQLFFLHFLGAGEMFLLVVMAFDRYIAICRPLHYSTIMNPRACYALSLVLWLGGFIHSIVQVALILHLPFCGPNQLDNFFCDVPQVIKLACTNTFVVELLMVSNSGLLSLLCFLGLLASYAVILCRIREHSSEGKSKAISTCTTHIIIIFLMFGPAIFIYTCPFQAFPADKVVSLFHTVIFPLMNPVIYTLRNQEVKASMRKLLSQHMFC

SEQ ID NO: 12500 - protein, 312 aa, Artificial Sequence
  Description of Artificial Sequence: Synthetic coding sequence
MEKSNNSTLFILLGFSQNKNIEVLCFVLFLFCYIAIWMGNLLIMISITCTQLIHQPMYFFLNYLSLSDLCYTSTVTPKLMVDLLAERKTISYNNCMIQLFTTHFFGGIEIFILTGMAYDRYVAICKPLHYTIIMSRQKCNTIIIVCCTGGFIHSASQFLLTIFVPFCGPNEIDHYFCDVYPLLKLACSNIHMIGLLVIANSGLIALVTFVVLLLSYVFILYTIRAYSAERRSKALATCSSHVIVVVLFFAPALFIYIRPVTTFSEDKVFALFYTIIAPMFNPLIYTLRNTEMKNAMRKVWCCQILLKRNQLF

SEQ ID NO: 12501 - protein, 313 aa, Artificial Sequence
  Description of Artificial Sequence: Synthetic coding sequence
MKKEQDSNVTEFVLLGLSSSWELQLFLFLLFLFFYIAIVLGNLLIVVTVQAHAHLLQSPMYYFLGHLSFIDLCLSCVTVPKMLGDFLQQGKSISFSGCLAQIYFLHFLGASEMFLLTVMAYDRYVAICNPLRYLTVMNPQLCLWLVLACWCGGFIHSIMQVILVIQLPFCGPNELDNFYCDVPQVIKLACMDTYVVEVLVIANSGLLSLVCFLVLLFSYAIILITLRTHFCQGQNKVFSTCASHLTVVSLIFVPCVFIYLRPFCSFSVDKIFSLFYTVITPMLNPLIYTLRNTDMKTAMKKLRIKPCGIPLPC

SEQ ID NO: 12502 - protein, 309 aa, Artificial Sequence
  Description of Artificial Sequence: Synthetic coding sequence
MGAKNNVTEFVLFGLFESREMQHTCFVVFFLFHVLTVLGNLLVIITINARKTLKSPMYFFLSQLSFADICYPSTTIPKMIADTFVEHKIISFNGCMTQLFSAHFFGGTEIFLLTAMAYDRYVAICRPLHYTAIMDCRKCGLLAGASWLAGFLHSILQTLLTVQLPFCGPNEIDNFFCDVHPLLKLACADTYMVGLIVVANSGMISLASFFILIISYVIILLNLRSQSSEDRRKAVSTCGSHVITVLLVLMPPMFMYIRPSTTLAADKLIILFNIVMPPLLNPLIYTLRNNDVKNAMRKLFRVKRSLGEK

SEQ ID NO: 12503 - protein, 311 aa, Artificial Sequence
  Description of Artificial Sequence: Synthetic coding sequence
MEKINNVTEFIFWGLSQSPEIEKVCFVVFSFFYIIILLGNLLIMLTVCLSNLFKSPMYFFLSFLSFVDICYSSVTAPKMIVDLLAKDKTISYVGCMLQLFGVHFFGCTEIFILTVMAYDRYVAICKPLHYMTIMNRETCNKMLLGTWVGGFLHSIIQVALVVQLPFCGPNEIDHYFCDVHPVLKLACTETYIVGVVVTANSGTIALGSFVILLISYSIILVSLRKQSAEGRRKALSTCGSHIAMVVIFFGPCTFMYMRPDTTFSEDKMVAVFYTIITPMLNPLIYTLRNAEVKNAMKKLWGRNVFLEAKGK

SEQ ID NO: 12504 - protein, 305 aa, Artificial Sequence
  Description of Artificial Sequence: Synthetic coding sequence
MVATNNVTEIIFVGFSQNWSEQRVISVMFLLMYTAVVLGNGLIVVTILASKVLTSPMYFFLSYLSFVEICYCSVMAPKLIFDSFIKRKVISLKGCLTQMFSLHFFGGTEAFLLMVMAYDRYVAICKPLHYMAIMNQRMCGLLVRIAWGGGLLHSVGQTFLIFQLPFCGPNIMDHYFCDVHPVLELACADTFFISLLIITNGGSISVVSFFVLMASYLIILHFLRSHNLEGQHKALSTCASHVTVVDLFFIPCSLVYIRPCVTLPADKIVAVFYTVVTPLLNPVIYSFRNAEVKNAMRRFIGGKVI

SEQ ID NO: 12505 - protein, 303 aa, Artificial Sequence
  Description of Artificial Sequence: Synthetic coding sequence
MTEFIFLVLSPNQEVQRVCFVIFLFLYTAIVLGNFLIVLTVMTSRSLGSPMYFFLSYLSFMEICYSSATAPKLISDLLAERKVISWWGCMAQLFFLHFFGGTEIFLLTVMAYDHYVAICKPLSYTTIMNWQVCTVLVGIAWVGGFMHSFAQILLIFHLLFCGPNVINHYFCDLVPLLKLACSDTFLIGLLIVANGGTLSVISFGVLLASYMVILLHLRTWSSEGWCKALSTCGSHFAVVILFFGPCVFNSLRPSTTLPIDKMVAVFYTVITAILNPVIYSLRNAEMRKAMKRLWIRTLRLNEK

SEQ ID NO: 12506 - protein, 315 aa, Artificial Sequence
  Description of Artificial Sequence: Synthetic coding sequence
MSITKAWNSSSVTMFILLGFTDHPELQALLFVTFLGIYLTTLAWNLALIFLIRGDTHLHTPMYFFLSNLSFIDICYSSAVAPNMLTDFFWEQKTISFVGCAAQFFFFVGMGLSECLLLTAMAYDRYAAISSPLLYPTIMTQGLCTRMVVGAYVGGFLSSLIQASSIFRLHFCGPNIINHFFCDLPPVLALSCSDTFLSQVVNFLVVVTVGGTSFLQLLISYGYIVSAVLKIPSAEGRWKACNTCASHLMVVTLLFGTALFVYLRPSSSYLLGRDKVVSVFYSLVIPMLNPLIYSLRNKEIKDALWKVLERKKVFS

SEQ ID NO: 12507 - protein, 324 aa, Artificial Sequence
  Description of Artificial Sequence: Synthetic coding sequence
MAVGRNNTIVTKFILLGLSDHPQMKIFLFMLFLGLYLLTLAWNLSLIALIKMDSHLHMPMYFFLSNLSFLDICYVSSTAPKMLSDIITEQKTISFVGCATQYFVFCGMGLTECFLLAAMAYDRYAAICNPLLYTVLISHTLCLKMVVGAYVGGFLSSFIETYSVYQHDFCGPYMINHFFCDLPPVLALSCSDTFTSEVVTFIVSVVVGIVSVLVVLISYGYIVAAVVKISSATGRTKAFSTCASHLTAVTLFYGSGFFMYMRPSSSYSLNRDKVVSIFYALVIPVVNPIIYSFRNKEIKNAMRKAMERDPGISHGGPFIFMTLG

SEQ ID NO: 12508 - protein, 309 aa, Artificial Sequence
  Description of Artificial Sequence: Synthetic coding sequence
MDISEGNKTLVTEFVLTGLTDRPWLHVLFFVVFLVVYLITMVGNLGLIVLIWNDPHLHMPMYLFLGGLAFSDACTSTSITPRMLVNFLDKTAMISLAECITQFYFFASSATTECFLLVMMAYDRYVAICNPLLYPVMMSNKLSAQLLSISYVIGFLHPLVHVSLLLRLTFCRFNIIHYFYCEILQLFKISCNGPSINALMIFIFGAFIQIPTLMTIIISYTRVLFDILKKKSEKGRSKAFSTCGAHLLSVSLYYGTLIFMYVRPASGLAEDQDKVYSLFYTIIIPLLNPFIYSLRNKKVMHALRRVIRK

SEQ ID NO: 12509 - protein, 309 aa, Artificial Sequence
  Description of Artificial Sequence: Synthetic coding sequence
MTLGNSTEVTEFYLLGFGAQHEFWCILFIVFLLIYVTSIMGNSGIILLINTDSRFQTLTYFFLQHLAFVDICYTSAITPKMLQSFTEEKNLMLFQGCVIQFLVYATFATSDCYLLAMMAVDPYVAICKPLHYTVIMSRTVCIRLVAGSYIMGSINASVQTGFTCSLSFCKSNSINHFFCDVPPILALSCSNVDINIMLLVVFVGSNLIFTGLVVIFSYIYIMATILKMSSSAGRKKSFSTCASHLTAVTIFYGTLSYMYLQSHSNNSQENMKVAFIFYGTVIPMLNPLIYSLRNKEVKEALKVIGKKLF

SEQ ID NO: 12510 - protein, 311 aa, Artificial Sequence
  Description of Artificial Sequence: Synthetic coding sequence
MTGGGNITEITYFILLGFSDFPRIIKVLFTIFLVIYITSLAWNLSLIVLIRMDSHLHTPMYFFLSNLSFIDVCYISSTVPKMLSNLLQEQQTITFVGCIIQYFIFSTMGLSESCLMTAMAYDRYAAICNPLLYSSIMSPTLCVWMVLGAYMTGLTASLFQIGALLQLHFCGSNVIRHFFCDMPQLLILSCTDTFFVQVMTAILTMFFGIASALVIMISYGYIGISIMKITSAKGRSKAFNTCASHLTAVSLFYTSGIFVYLSSSSGGSSSFDRFASVFYTVVIPMLNPLIYSLRNKEIKDALKRLQKRKCC

SEQ ID NO: 12511 - protein, 316 aa, Artificial Sequence
  Description of Artificial Sequence: Synthetic coding sequence
MRLMKEVRGRNQTEVTEFLLLGLSDNPDLQGVLFALFLLIYMANMVGNLGMIVLIKIDLCLHTPMYFFLSSLSFVDASYSSSVTPKMLVNLMAENKAISFHGCAAQFYFFGSFLGTECFLLAMMAYDRYAAIWNPLLYPVLVSGRICFLLIATSFLAGCGNAAIHTGMTFRLSFCGSNRINHFYCDTPPLLKLSCSDTHFNGIVIMAFSSFIVISCVMIVLISYLCIFIAVLKMPSLEGRHKAFSTCASYLMAVTIFFGTILFMYLRPTSSYSMEQDKVVSVFYTVIIPVLNPLIYSLKNKDVKKALKKILWKHIL

SEQ ID NO: 12512 - protein, 317 aa, Artificial Sequence
  Description of Artificial Sequence: Synthetic coding sequence
MMRLMKEVRGRNQTEVTEFLLLGLSDNPDLQGVLFALFLLIYMANMVGNLGMIVLIKIDLCLHTPMYFFLSSLSFVDASYSSSVTPKMLVNLMAENKAISFHGCAAQFYFFGSFLGTECFLLAMMAYDRYAAIWNPLLYPVLVSGRICFLLIATSFLAGCGNAAIHTGMTFRLSFCGSNRINHFYCDTPPLLKLSCSDTHFNGIVIMAFSSFIVISCVMIVLISYLCIFIAVLKMPSLEGRHKAFSTCASYLMAVTIFFGTILFMYLRPTSSYSMEQDKVVSVFYTVIIPVLNPLIYSLKNKDVKKALKKILWKHIL

SEQ ID NO: 12513 - protein, 310 aa, Artificial Sequence
  Description of Artificial Sequence: Synthetic coding sequence
MDKENSSMVTEFIFMGITQDPQMEIIFFVVFLIVYLVNVVGNIGMIILITTDTQLHTPMYFFLCNLSFVDLGYSSAIAPRMLADFLTNHKVISFSSCATQFAFFVGFVDAECYVLAAMAYGRFVAICRPLHYSTFMSKQVCLALMLGSYLAGLVSLVAHTTLTFSLSYCGSNIINHFFCEIPPLLALSCSDTYISEILLFSLCGFIEFSTILIIFISYTFILVAIIRMRSAEGRLKAFSTCGSHLTGITLFYGTVMFMYLRPTSSYSLDQDKWASVFYTVIIPMLNPLIYSLRNKDVKAAFKKLIGKKSQ

SEQ ID NO: 12514 - protein, 324 aa, Artificial Sequence
  Description of Artificial Sequence: Synthetic coding sequence
MLESNYTMPTEFLFVGFTDYLPLRVTLFLVFLLVYTLTMVGNILLIILVNINSSLQIPMYYFLSNLSFLDISCSTAITPKMLANFLASRKSISPYGCALQMFFFASFADAECLILAAMAYDRYAAICNPLLYTTLMSRRVCVCFIVLAYFSGSTTSLVHVCLTFRLSFCGSNIVNHFFCDIPPLLALSCTDTQINQLLLFALCSFIQTSTFVVIFISYFCILITVLSIKSSGGRSKTFSTCASHLIAVTLFYGALLFMYLQPTTSYSLDTDKVVAVFYTVVFPMFNPIIYSFRNKDVKNALKKLLERIGYSNEWYLNRLRIVNI

SEQ ID NO: 12515 - protein, 362 aa, Artificial Sequence
  Description of Artificial Sequence: Synthetic coding sequence
MTEFHLQSQMPSIRLIFRRLSLGRIKPSQSPRCSTSFMVVPSFSIAEHWRRMKGANLSQGMEFELLGLTTDPQLQRLLFVVFLGMYTATLLGNLVMFLLIHVSATLHTPMYSLLKSLSFLDFCYSSTVVPQTLVNFLAKRKVISYFGCMTQMFFYAGFATSECYLIAAMAYDRYAAICNPLLYSTIMSPEVCASLIVGSYSAGFLNSLIHTGCIFSLKFCGAHVVTHFFCDGPPILSLSCVDTSLCEILLFIFAGFNLLSCTLTILISYFLILNTILKMSSAQGRFKAFSTCASHLTAICLFFGTTLFMYLRPRSSYSLTQDRTVAVIYTVVIPVLNPLMYSLRNKDVKKALIKVWGRKTME

SEQ ID NO: 12516 - protein, 314 aa, Artificial Sequence
  Description of Artificial Sequence: Synthetic coding sequence
MENNTEVTEFILVGLTDDPELQIPLFIVFLFIYLITLVGNLGMIELILLDSCLHTPMYFFLSNLSLVDFGYSSAVTPKVMVGFLTGDKFILYNACATQFFFFVAFITAESFLLASMAYDRYAALCKPLHYTTTMTTNVCACLAIGSYICGFLNASIHTGNTFRLSFCRSNVVEHFFCDAPPLLTLSCSDNYISEMVIFFVVGFNDLFSILVILISYLFIFITIMKMRSPEGRQKAFSTCASHLTAVSIFYGTGIFMYLRPNSSHFMGTDKMASVFYAIVIPMLNPLVYSLRNKEVKSAFKKTVGKAKASIGFIF

SEQ ID NO: 12517 - protein, 314 aa, Artificial Sequence
  Description of Artificial Sequence: Synthetic coding sequence
MENNTEVSEFILLGLTNAPELQVPLFIMFTLIYLITLTGNLGMIILILLDSHLHTPMYFFLSNLSLAGIGYSSAVTPKVLTGLLIEDKAISYSACAAQMFFCAVFATVENYLLSSMAYDRYAAVCNPLHYTTTMTTRVCACLAIGCYVIGFLNASIQIGDTFRLSFCMSNVIHHFFCDKPAVITLTCSEKHISELILVLISSFNVFFALLVTLISYLFILITILKRHTGKGYQKPLSTCGSHLIAIFLFYITVIIMYIRPSSSHSMDTDKIASVFYTMIIPMLSPIVYTLRNKDVKNAFMKVVEKAKYSLDSVF

SEQ ID NO: 12518 - protein, 309 aa, Artificial Sequence
  Description of Artificial Sequence: Synthetic coding sequence
MENCTEVTKFILLGLTSVPELQIPLFILFTFIYLLTLCGNLGMMLLILMDSCLHTPMYFFLSNLSLVDFGYSSAVTPKVMAGFLRGDKVISYNACAVQMFFFVALATVENYLLASMAYDRYAAVCKPLHYTTTMTASVGACLALGSYVCGFLNASFHIGGIFSLSFCKSNLVHHFFCDVPAVMALSCSDKHTSEVILVFMSSFNIFFVLLVIFISYLFIFITILKMHSAKGHQKALSTCASHFTAVSVFYGTVIFIYLQPSSSHSMDTDKMASVFYAMIIPMLNPVVYSLRNREVQNAFKKVLRRQKFL

SEQ ID NO: 12519 - protein, 314 aa, Artificial Sequence
  Description of Artificial Sequence: Synthetic coding sequence
MENKTEVTQFILLGLTNDSELQVPLFITFPFIYIITLVGNLGIIVLIFWDSCLHNPMYFFLSNLSLVDFCYSSAVTPIVMAGFLIEDKVISYNACAAQMYIFVAFATVENYLLASMAYDRYAAVCKPLHYTTTMTTTVCARLAIGSYLCGFLNASIHTGDTFSLSFCKSNEVHHFFCDIPAVMVLSCSDRHISELVLIYVVSFNIFIALLVILISYTFIFITILKMHSASVYQKPLSTCASHFIAVGIFYGTIIFMYLQPSSSHSMDTDKMAPVFYTMVIPMLNPLVYSLRNKEVKSAFKKVVEKAKLSVGWSV

SEQ ID NO: 12520 - protein, 320 aa, Artificial Sequence
  Description of Artificial Sequence: Synthetic coding sequence
MNSENLTRAAVAPAEFVLLGITNRWDLRVALFLTCLPVYLVSLLGNMGMALLIRMDARLHTPMYFFLANLSLLDACYSSAIGPKMLVDLLLPRATIPYTACALQMFVFAGLADTECCLLAAMAYDRYVAIRNPLLYTTAMSQRLCLALLGASGLGGAVSAFVHTTLTFRLSFCRSRKINSFFCDIPPLLAISCSDTSLNELLLFAICGFIQTATVLAITVSYGFIAGAVIHMRSVEGSRRAASTGGSHLTAVAMMYGTLIFMYLRPSSSYALDTDKMASVFYTLVIPSLNPLIYSLRNKEVKEALRQTWSRFHCPGQGSQ

SEQ ID NO: 12521 - protein, 314 aa, Artificial Sequence
  Description of Artificial Sequence: Synthetic coding sequence
MMASERNQSSTPTFILLGFSEYPEIQVPLFLVFLFVYTVTVVGNLGMIIIIRLNSKLHTIMCFFLSHLSLTDFCFSTVVTPKLLENLVVEYRTISFSGCIMQFCFACIFGVTETFMLAAMAYDRFVAVCKPLLYTTIMSQKLCALLVAGSYTWGIVCSLILTYFLLDLSFCESTFINNFICDHSVIVSASYSDPYISQRLCFIIAIFNEVSSLIIILTSYMLIFTTIMKMRSASGRQKTFSTCASHLTAITIFHGTILFLYCVPNPKTSSLIVTVASVFYTVAIPMLNPLIYSLRNKDINNMFEKLVVTKLIYH

SEQ ID NO: 12522 - protein, 314 aa, Artificial Sequence
  Description of Artificial Sequence: Synthetic coding sequence
MMMVLRNLSMEPTFALLGFTDYPKLQIPLFLVFLLMYVITVVGNLGMIIIIKINPKFHTPMYFFLSHLSFVDFCYSSIVTPKLLENLVMADKSIFYFSCMMQYFLSCTAVVTESFLLAVMAYDRFVAICNPLLYTVAMSQRLCALLVAGSYLWGMFGPLVLLCYALRLNFSGPNVINHFFCEYTALISVSGSDILIPHLLLFSFATFNEMCTLLIILTSYVFIFVTVLKIRSVSGRHKAFSTWASHLTSITIFHGTILFLYCVPNSKNSRQTVKVASVFYTVVNPMLNPLIYSLRNKDVKDAFWKLIHTQVPFH

SEQ ID NO: 12523 - protein, 328 aa, Artificial Sequence
  Description of Artificial Sequence: Synthetic coding sequence
MFLTERNTTSEATFTLLGFSDYLELQIPLFFVFLAVYGFSVVGNLGMIVIIKINPKLHTPMYFFLNHLSFVDFCYSSIIAPMMLVNLVVEDRTISFSGCLVQFFFFCTFVVTELILFAVMAYDHFVAICNPLLYTVAISQKLCAMLVVVLYAWGVACSLTLACSALKLSFHGFNTINHFFCELSSLISLSYPDSYLSQLLLFTVATFNEISTLLIILTSYAFIIVTTLKMPSASGHRKVFSTCASHLTAITIFHGTILFLYCVPNSKNSRHTVKVASVFYTVVIPLLNPLIYSLRNKDVKDAIRKIINTKYFHIKHRHWYPFNFVIEQ

SEQ ID NO: 12524 - protein, 313 aa, Artificial Sequence
  Description of Artificial Sequence: Synthetic coding sequence
MLLTDRNTSGTTFTLLGFSDYPELQVPLFLVFLAIYNVTVLGNIGLIVIIKINPKLHTPMYFFLSQLSFVDFCYSSIIAPKMLVNLVVKDRTISFLGCVVQFFFFCTFVVTESFLLAVMAYDRFVAICNPLLYTVNMSQKLCVLLVVGSYAWGVSCSLELTCSALKLCFHGFNTINHFFCEFSSLLSLSCSDTYINQWLLFFLATFNEISTLLIVLTSYAFIVVTILKMRSVSGRRKAFSTCASHLTAITIFHGTILFLYCVPNSKNSRHTVKVASVFYTVVIPMLNPLIYSLRNKDVKDTVTEILDTKVFSY

SEQ ID NO: 12525 - protein, 314 aa, Artificial Sequence
  Description of Artificial Sequence: Synthetic coding sequence
MTRKNYTSLTEFVLLGLADTLELQIILFLFFLVIYTLTVLGNLGMILLIRIDSQLHTPMYFFLANLSFVDVCNSTTITPKMLADLLSEKKTISFAGCFLQMYFFISLATTECILFGLMAYDRYAAICRPLLYSLIMSRTVYLKMAAGAFAAGLLNFMVNTSHVSSLSFCDSNVIHHFFCDSPPLFKLSCSDTILKESISSILAGVNIVGTLLVILSSYSYVLFSIFSMHSGEGRHRAFSTCASHLTAIILFYATCIYTYLRPSSSYSLNQDKVASVFYTVVIPMLNPLIYSLRSKEVKKALANVISRKRTSSFL

SEQ ID NO: 12526 - protein, 310 aa, Artificial Sequence
  Description of Artificial Sequence: Synthetic coding sequence
MEEENATLLTEFVLTGFLYQPQWKIPLFLAFLVIYLITIMGNLGLIAVIWKDPHLHIPMYLLLGNLAFVDALLSSSVTLKMLINFLAKSKMISLSECKIQLFSFAISVTTECFLLATMAYDRYVAICKPLLYPAIMTNGLCIRLLILSYVGGLLHALIHEGFLFRLTFCNSNIIQHFYCDIIPLLKISYTDSSINFLMVFIFAGSIQVFTIGTVLISYIFVLYTILKKKSVKGMRKAFSTCGAHLLSVSLYYGPLAFMYMGSASPQADDQDMMESLFYTVIVPLLNPMIYSLRNKQVIASFTKMFKRNDV

SEQ ID NO: 12527 - protein, 314 aa, Artificial Sequence
  Description of Artificial Sequence: Synthetic coding sequence
MSNEDMEQDNTTLLTEFVLTGLTYQPEWKMPLFLVFLVIYLITIVWNLGLIALIWNDPQLHIPMYFFLGSLAFVDAWISSTVTPKMLVNFLAKNRMISLSECMIQFFSFAFGGTTECFLLATMAYDRYVAICKPLLYPVIMNNSLCIRLLAFSFLGGFLHALIHEVLIFRLTFCNSNIIHHFYCDIIPLFMISCTDPSINFLMVFILSGSIQVFTIVTVLNSYTFALFTILKKKSVRGVRKAFSTCGAHLLSVSLYYGPLIFMYLRPASPQADDQDMIDSVFYTIIIPLLNPIIYSLRNKQVIDSFTKMVKRNV

SEQ ID NO: 12528 - protein, 314 aa, Artificial Sequence
  Description of Artificial Sequence: Synthetic coding sequence
MEFTDRNYTLVTEFILLGFPTRPELQIVLFLMFLTLYAIILIGNIGLMLLIRIDPHLQTPMYFFLSNLSFVDLCYFSDIVPKMLVNFLSENKSISYYGCALQFYFFCTFADTESFILAAMAYDRYVAICNPLLYTVVMSRGICMRLIVLSYLGGNMSSLVHTSFAFILKYCDKNVINHFFCDLPPLLKLSCTDTTINEWLLSTYGSSVEIICFIIIIISYFFILLSVLKIRSFSGRKKTFSTCASHLTSVTIYQGTLLFIYSRPSYLYSPNTDKIISVFYTIFIPVLNPLIYSLRNKDVKDAAEKVLRSKVDSS

SEQ ID NO: 12529 - protein, 312 aa, Artificial Sequence
  Description of Artificial Sequence: Synthetic coding sequence
MADDNFTVVTEFILLGLTDHAELKAVLFVVFLVIYAITLLRNLGMILLIQITSKLHTPMYFLLSCLSFVDACYSSAIAPKMLVNLLVVKATISFSACMVQHLCFGVFITTEGFLLSVMAYDRYVAIVSPLLYTVAMSDRKCVELVTGSWIGGIVNTLIHTISLRRLSFCRLNAVSHFFCDIPSLLKLSCSDTSMNELLLLTFSGVIAMATFLTVIISYIFIAFASLRIHSASGRQQAFSTCASHLTAVTIFYGTLIFSYIQPSSQYFVEQEKVVSMFYTLGIPMLNLLIHSLRNKDVKEAVKRAIEMKHFLC

SEQ ID NO: 12530 - protein, 308 aa, Artificial Sequence
  Description of Artificial Sequence: Synthetic coding sequence
MAEENHTMKNEFILTGFTDHPELKTLLFVVFFAIYLITVVGNISLVALIFTHRRLHTPMYIFLGNLALVDSCCACAITPKMLENFFSENKRISLYECAVQFYFLCTVETADCFLLAAMAYDRYVAICNPLQYHIMMSKKLCIQMTTGAFIAGNLHSMIHVGLVFRLVFCGSNHINHFYCDILPLYRLSCVDPYINELVLFIFSGSVQVFTIGSVLISYLYILLTIFKMKSKEGRAKAFSTCASHFLSVSLFYGSLFFMYVRPNLLEEGDKDIPAAILFTIVVPLLNPFIYSLRNREVISVLRKILMKK

SEQ ID NO: 12531 - protein, 316 aa, Artificial Sequence
  Description of Artificial Sequence: Synthetic coding sequence
MVEENHTMKNEFILTGFTDHPELKTLLFVVFFAIYLITVVGNISLVALIFTHCRLHTPMYIFLGNLALVDSCCACAITPKMLENFFSEGKRISLYECAVQFYFLCTVETADCFLLAAVAYDRYVAICNPLQYHIMMSKKLCIQMTTGAFIAGNLHSMIHVGLVFRLVFCGLNHINHFYCDTLPLYRLSCVDPFINELVLFIFSGSVQVFTIGSVLISYLYILLTIFRMKSKEGRAKAFSTCASHFSSVSLFYGSIFFLYIRPNLLEEGGNDIPAAILFTIVVPLLNPFIYSLRNKEVISVLRKILLKIKSQGSVNK

SEQ ID NO: 12532 - protein, 321 aa, Artificial Sequence
  Description of Artificial Sequence: Synthetic coding sequence
MARENHSLAAEFILIGFTNYPELKTLLFVVFSAIYLVTMVGNLGLVALIYVERRLLTPMYIFLGNLALMDSCCSCAVTPKMLENFFSEDRIISLYECMAQFYFLCLAETTDCFLLATMAYDRYVAICHPLQYHTMMSKTLCIRMTTGAFKAGNLHSMIHVGLLLRLTFCRSNKIHHFFCDILPLYRLSCTDPSINELMIYIFSIPIQIFTIATVLISYLCILLTVFKMKSKEGRGKAFSTCASHFLSVSIFYICLLMYIGPSEEGDKDTPVAIFYAIVIPLLNPFIYSLRNKEVINVLKKIMRNYNILKQTCSIANLFLIY

SEQ ID NO: 12533 - protein, 311 aa, Artificial Sequence
  Description of Artificial Sequence: Synthetic coding sequence
MGKENCTTVAEFILLGLSDVPELRVCLFLLFLLIYGVTLLANLGMIALIQVSSRLHTPMYFFLSHLSSVDFCYSSIIVPKMLANIFNKDKAISFLGCMVQFYLFCTCVVTEVFLLAVMAYDRFVAICNPLLYTVTMSWKVRVELASCCYFCGTVCSLIHLCLALRIPFYRSNVINHFFCDLPPVLSLACSDITVNETLLFLVATLNESVTIMIILTSYLLILTTILKMGSAEGRHKAFSTCASHLTAITVFHGTVLSIYCRPSSGNSGDADKVATVFYTVVIPMLNSVIYSLRNKDVKEALRKVMGSKIHS

SEQ ID NO: 12534 - protein, 311 aa, Artificial Sequence
  Description of Artificial Sequence: Synthetic coding sequence
MGKENCTTVAEFILLGLSDVPELRVCLFLLFLLIYGVTLLANLGMTALIQVSSRLHTPVYFFLSHLSFVDFCYSSIIVPKMLANIFNKDKAISFLGCMVQFYLFCTCGVTEVFLLAVMAYDRFVAICNPLLYMVTMSQKLRVELTSCCYFCGTVCSLIHSSLALRILFYRSNVINHFFCDLPPLLSLACSDVTVNETLLFLVATLNESVTIMIILTSYLLILTTILKIHSAESRHKAFSTCASHLTAITVSHGTILYIYCRPSSGNSGDVDKVATVFYTVVIPMLNPLIYSLRNKDVNKALRKVMGSKIHS

SEQ ID NO: 12535 - protein, 315 aa, Artificial Sequence
  Description of Artificial Sequence: Synthetic coding sequence
MFSPNHTIVTEFILLGLTDDPVLEKILFGVFLAIYLITLAGNLCMILLIRTNSHLQTPMYFFLGHLSFVDICYSSNVTPNMLHNFLSEQKTISYAGCFTQCLLFIALVITEFYILASMALDRYVAICSPLHYSSRMSKNICVCLVTIPYMYGFLSGFSQSLLTFHLSFCGSLEINHFYCADPPLIMLACSDTRVKKMAMFVVAGFNLSSSLFIILLSYLFIFAAIFRIRSAEGRHKAFSTCASHLTIVTLFYGTLFCMYVRPPSEKSVEESKITAVFYTFLSPMLNPLIYSLRNTDVILAMQQMIRGKSFHKIAV

SEQ ID NO: 12536 - protein, 315 aa, Artificial Sequence
  Description of Artificial Sequence: Synthetic coding sequence
MLSPNHTIVTEFILLGLTDDPVLEKILFGVFLAIYLITLAGNLCMILLIRTNSQLQTPMYFFLGHLSFVDICYSSNVTPNMLHNFLSEQKTISYAGCFTQCLLFIALVITEFYFLASMALDRYVAICSPLHYSSRMSKNICISLVTVPYMYGFLNGLSQTLLTFHLSFCGSLEINHFYCADPPLIMLACSDTRVKKMAMFVVAGFTLSSSLFIILLSYLFIFAAIFRIRSAEGRHKAFSTCASHLTIVTLFYGTLFCMYVRPPSEKSVEESKIIAVFYTFLSPMLNPLIYSLRNRDVILAIQQMIRGKSFCKIAV

SEQ ID NO: 12537 - protein, 305 aa, Artificial Sequence
  Description of Artificial Sequence: Synthetic coding sequence
MSNTNGSAITEFILLGLTDCPELQSLLFVLFLVVYLVTLLGNLGMIMLMRLDSRLHTPMYFFLTNLAFVDLCYTSNATPQMSTNIVSEKTISFAGCFTQCYIFIALLLTEFYMLAAMAYDRYVAIYDPLRYSVKTSRRVCICLATFPYVYGFSDGLFQAILTFRLTFCRSSVINHFYCADPPLIKLSCSDTYVKEHAMFISAGFNLSSSLTIVLVSYAFILAAILRIKSAEGRHKAFSTCGSHMMAVTLFYGTLFCMYIRPPTDKTVEESKIIAVFYTFVSPVLNPLIYSLRNKDVKQALKNVLR

SEQ ID NO: 12538 - protein, 307 aa, Artificial Sequence
  Description of Artificial Sequence: Synthetic coding sequence
MLNFTDVTEFILLGLTSRREWQVLFFIIFLVVYIITMVGNIGMMVLIKVSPQLNNPMYFFLSHLSFVDVWFSSNVTPKMLENLLSDKKTITYAGCLVQCFFFIALVHVEIFILAAMAFDRYMAIGNPLLYGSKMSRVVCIRLITFPYIYGFLTSLAATLWTYGLYFCGKIEINHFYCADPPLIKMACAGTFVKEYTMIILAGINFTYSLTVIIISYLFILIAILRMRSAEGRQKAFSTCGSHLTAVIIFYGTLIFMYLRRPTEESVEQGKMVAVFYTTVIPMLNPMIYSLRNKDVKKAMMKVISRSC

SEQ ID NO: 12539 - protein, 311 aa, Artificial Sequence
  Description of Artificial Sequence: Synthetic coding sequence
MRRNCTLVTEFILLGLTSRRELQILLFTLFLAIYMVTVAGNLGMIVLIQANAWLHMPMYFFLSHLSFVDLCFSSNVTPKMLEIFLSEKKSISYPACLVQCYLFIALVHVEIYILAVMAFDRYMAICNPLLYGSRMSKSVCSFLITVPYVYGALTGLMETMWTYNLAFCGPNEINHFYCADPPLIKLACSDTYNKELSMFIVAGWNLSFSLFIICISYLYIFPAILKIRSTEGRQKAFSTCGSHLTAVTIFYATLFFMYLRPPSKESVEQGKMVAVFYTTVIPMLNLIIYSLRNKNVKEALIKELSMKIYFS

SEQ ID NO: 12540 - protein, 310 aa, Artificial Sequence
  Description of Artificial Sequence: Synthetic coding sequence
MPNFTDVTEFTLLGLTCRQELQVLFFVVFLAVYMITLLGNIGMIILISISPQLQSPMYFFLSHLSFADVCFSSNVTPKMLENLLSETKTISYVGCLVQCYFFIAVVHVEVYILAVMAFDRYMAGCNPLLYGSKMSRTVCVRLISVPYVYGFSVSLICTLWTYGLYFCGNFEINHFYCADPPLIQIACGRVHIKEITMIVIAGINFTYSLSVVLISYTLIVVAVLRMRSADGRRKAFSTCGSHLTAVSMFYGTPIFMYLRRPTEESVEQGKMVAVFYTTVIPMLNPMIYSLRNKDVKEAVNKAITKTYVRQ

SEQ ID NO: 12541 - protein, 322 aa, Artificial Sequence
  Description of Artificial Sequence: Synthetic coding sequence
MNSLKDGNHTALTGFILLGLTDDPILRVILFMIILSGNLSIIILIRISSQLHHPMYFFLSHLAFADMAYSSSVTPNMLVNFLVERNTVSYLGCAIQLGSAAFFATVECVLLAAMAYDRFVAICSPLLYSTKMSTQVSVQLLLVVYIAGFLIAVSYTTSFYFLLFCGPNQVNHFFCDFAPLLELSCSDISVSTVVLSFSSGSIIVVTVCVIAVCYIYILITILKMRSTEGHHKAFSTCTSHLTVVTLFYGTITFIYVMPNFSYSTDQNKVVSVLYTVVIPMLNPLIYSLRNKEIKGALKRELVRKILSHDACYFSRTSNNDIT

SEQ ID NO: 12542 - protein, 311 aa, Artificial Sequence
  Description of Artificial Sequence: Synthetic coding sequence
MGTGNDTTVVEFTLLGLSEDTTVCAILFLVFLGIYVVTLMGNISIIVLIRRSHHLHTPMYIFLCHLAFVDIGYSSSVTPVMLMSFLRKETSLPVAGCVAQLCSVVTFGTAECFLLAAMAYDRYVAICSPLLYSTCMSPGVCIILVGMSYLGGCVNAWTFIGCLLRLSFCGPNKVNHFFCDYSPLLKLACSHDFTFEIIPAISSGSIIVATVCVIAISYIYILITILKMHSTKGRHKAFSTCTSHLTAVTLFYGTITFIYVMPKSSYSTDQNKVVSVFYTVVIPMLNPLIYSLRNKEIKGALKRELRIKIFS

SEQ ID NO: 12543 - protein, 324 aa, Artificial Sequence
  Description of Artificial Sequence: Synthetic coding sequence
MAEVNIIYVTVFILKGITNRPELQAPCFGVFLVIYLVTVLGNLGLITLIKIDTRLHTPMYYFLSHLAFVDLCYSSAITPKMMVNFVVERNTIPFHACATQLGCFLTFMITECFLLASMAYDCYVAICSPLHYSTLMSRRVCIQLVAVPYIYSFLVALFHTVITFRLTYCGPNLINHFYCDDLPFLALSCSDTHMKEILIFAFAGFDMISSSSIVLTSYIFIIAAILRIRSTQGQHKAISTCGSHMVTVTIFYGTLIFMYLQPKSNHSLDTDKMASVFYTVVIPMLNPLIYSLRNKEVKDASKKALDKGCENLQILTFLKIRKLY

SEQ ID NO: 12544 - protein, 326 aa, Artificial Sequence
  Description of Artificial Sequence: Synthetic coding sequence
MSGLPSDMDLYKLQLNNFTEVTMFILISFTEEFDVQVFLFLLFLAIYLFTLIGNLGLVVPIIGDFWLHSPMYYFLGVLSFLDVCYSTVVTPKMLVNFLAKNKSISFLGCATQMFLACTFGTTECFLLAAMAYDRYVAIYNPLLYSVSMSPRVYVPLITASYVASILHATIHTVATFSLSFCGSNEIRHVFCNMPPLLAISCSDTHVIQLLFFYFVGSIEIVTILIVLISYGFILLAILKMQSAEGRRKVFSTCGAHLTGVTIYHGTILFMYVRPSSSYTSDNDMIVSIFYTIVIPMLNPIIYSLRNKDVKEAIKRLLVRNWFINKL

SEQ ID NO: 12545 - protein, 359 aa, Artificial Sequence
  Description of Artificial Sequence: Synthetic coding sequence
MSYSIYKSTVNIPLSHGVVHSFCHNMNCNFMHIFKFVLDFNMKNVTEVTLFVLKGFTDNLELQTIFFFLFLAIYLFTLMGNLGLILVVIRDSQLHKPMYYFLSMLSSVDACYSSVITPNMLVDFTTKNKVISFLGCVAQVFLACSFGTTECFLLAAMAYDRYVAIYNPLLYSVSMSPRVYMPLINASYVAGILHATIHTVATFSLSFCGANEIRRVFCDIPPLLAISYSDTHTNQLLLFYFVGSIELVTILIVLISYGLILLAILKMYSAEGRRKVFSTCGAHLTGVSIYYGTILFMYVRPSSSYASDHDMIVSIFYTIVIPLLNPVIYSLRNKDVKDSMKKMFGKNQVINKVYFHTKK

SEQ ID NO: 12546 - protein, 340 aa, Artificial Sequence
  Description of Artificial Sequence: Synthetic coding sequence
MDSTFTGYNLYNLQVKTEMDKLSSGLDIYRNPLKNKTEVTMFILTGFTDDFELQVFLFLLFFAIYLFTLIGNLGLVVLVIEDSWLHNPMYYFLSVLSFLDACYSTVVTPKMLVNFLAKNKSISFIGCATQMLLFVTFGTTECFLLAAMAYDHYVAIYNPLLYSVSMSPRVYVPLITASYVAGILHATIHIVATFSLSFCGSNEIRHVFCDMPPLLAISCSDTHTNQLLLFYFVGSIEIVTILIVLISCDFILLSILKMHSAKGRQKAFSTCGSHLTGVTIYHGTILVSYMRPSSSYASDHDIIVSIFYTIVIPKLNPIIYSLRNKEVKKAVKKMLKLVYK

SEQ ID NO: 12547 - protein, 321 aa, Artificial Sequence
  Description of Artificial Sequence: Synthetic coding sequence
MERKNQTAITEFIILGFSNLNELQFLLFTIFFLTYFCTLGGNILIILTTVTDPHLHTPMYYFLGNLAFIDICYTTSNVPQMMVHLLSKKKSISYVGCVVQLFAFVFFVGSECLLLAAMAYDRYIAICNPLRYSVILSKVLCNQLAASCWAAGFLNSVVHTVLTFCLPFCGNNQINYFFCDIPPLLILSCGNTSVNELALLSTGVFIGWTPFLCIVLSYICIISTILRIQSSEGRRKAFSTCASHLAIVFLFYGSAIFTYVRPISTYSLKKDRLVSVLYSVVTPMLNPIIYTLRNKDIKEAVKTIGSKWQPPISSLDSKLTY

SEQ ID NO: 12548 - protein, 321 aa, Artificial Sequence; identical to SEQ ID NO: 12547
  Description of Artificial Sequence: Synthetic coding sequence

SEQ ID NO: 12549 - protein, 321 aa, Artificial Sequence; identical to SEQ ID NO: 12547
  Description of Artificial Sequence: Synthetic coding sequence

SEQ ID NO: 12550 - protein, 321 aa, Artificial Sequence; identical to SEQ ID NO: 12547
  Description of Artificial Sequence: Synthetic coding sequence

SEQ ID NO: 12551 - protein, 321 aa, Artificial Sequence; identical to SEQ ID NO: 12547
  Description of Artificial Sequence: Synthetic coding sequence

SEQ ID NO: 12552 - protein, 321 aa, Artificial Sequence; identical to SEQ ID NO: 12547
  Description of Artificial Sequence: Synthetic coding sequence

SEQ ID NO: 12553 - protein, 321 aa, Artificial Sequence; identical to SEQ ID NO: 12547
  Description of Artificial Sequence: Synthetic coding sequence

SEQ ID NO: 12554 - protein, 321 aa, Artificial Sequence; identical to SEQ ID NO: 12547
  Description of Artificial Sequence: Synthetic coding sequence

SEQ ID NO: 12555 - protein, 321 aa, Artificial Sequence; identical to SEQ ID NO: 12547
  Description of Artificial Sequence: Synthetic coding sequence

SEQ ID NO: 12556 - protein, 310 aa, Artificial Sequence
  Description of Artificial Sequence: Synthetic coding sequence
MDWENCSSLTDFFLLGITNNPEMKVTLFAVFLAVYIINFSANLGMIVLIRMDYQLHTPMYFFLSHLSFCDLCYSTATGPKMLVDLLAKNKSIPFYGCALQFLVFCIFADSECLLLSVMAFDRYKAIINPLLYTVNMSSRVCYLLLTGVYLVGIADALIHMTLAFRLCFCGSNEINHFFCDIPPLLLLSRSDTQVNELVLFTVFGFIELSTISGVFISYCYIILSVLEIHSAEGRFKALSTCTSHLSAVAIFQGTLLFMYFRPSSSYSLDQDKMTSLFYTLVVPMLNPLIYSLRNKDVKEALKKLKNKILF

SEQ ID NO: 12557 - protein, 313 aa, Artificial Sequence
  Description of Artificial Sequence: Synthetic coding sequence
MSIINTSYVEITTFFLVGMPGLEYAHIWISIPICSMYLIAILGNGTILFIIKTEPSLHGPMYYFLSMLAMSDLGLSLSSLPTVLSIFLFNAPETSSSACFAQEFFIHGFSVLESSVLLIMSFDRFLAIHNPLRYTSILTTVRVAQIGIVFSFKSMLLVLPFPFTLRSLRYCKKNQLSHSYCLHQDVMKLACSDNRIDVIYGFFGALCLMVDFILIAVSYTLILKTVPGIASKKEELKALNTCVSHICAVIIFYLPIINLAVVHRFAGHVSPLINVLMANVLLLVPPLMKPIVYCVKTKQIRVRVVAKLCQWKI

SEQ ID NO: 12558 - protein, 313 aa, Artificial Sequence
  Description of Artificial Sequence: Synthetic coding sequence
MSIINTSYVEITTFFLVGMPGLEYAHIWISIPICSMYLIAILGNGTILFIIKTEPSLHEPMYYFLSMLAMSDLGLSLSSLPTVLSIFLFNAPEISSNACFAQEFFIHGFSVLESSVLLIMSFDRFLAIHNPLRYTSILTTVRVAQIGIVFSFKSMLLVLPFPFTLRNLRYCKKNQLSHSYCLHQDVMKLACSDNRIDVIYGFFGALCLMVDFILIAVSYTLILKTVLGIASKKEQLKALNTCVSHICAVIIFYLPIINLAVVHRFARHVSPLINVLMANVLLLVPPLTNPIVYCVKTKQIRVRVVAKLCQRKI

SEQ ID NO: 12559 - protein, 312 aa, Artificial Sequence
  Description of Artificial Sequence: Synthetic coding sequence
MSVLNNSEVKLFLLIGIPGLEHAHIWFSIPICLMYLLAIMGNCTILFIIKTEPSLHEPMYYFLAMLAVSDMGLSLSSLPTMLRVFLFNAMGISPNACFAQEFFIHGFTVMESSVLLIMSLDRFLAIHNPLRYSSILTSNRVAKMGLILAIRSILLVIPFPFTLRRLKYCQKNLLSHSYCLHQDTMKLACSDNKTNVIYGFFIALCTMLDLALIVLSYVLILKTILSIASLAERLKALNTCVSHICAVLTFYVPIITLAAMHHFAKHKSPLVVILIADMFLLVPPLMNPIVYCVKTRQIWEKILGKLLNVCGR

SEQ ID NO: 12560 - protein, 297 aa, Artificial Sequence
  Description of Artificial Sequence: Synthetic coding sequence
FLLIGIPGLEHAHIWFSIPICLMYLLAIMGNCTILFIIKTEPSLHEPMYYFLAMLAVSDMGLSLSSLPTMLRVFLFNAMGISPNACFAQEFFIHGFTVMESSVLLIMSLDRFLAIHNPLRYSSILTSNRVAKMGLILAIRSILLVIPFPFTLRRLKYCQKNLLSHSYCLHQDTMKLACSDNKTNVIYGFFIALCTMLDLALIVLSYVLILKTILSIASLAERLKALNTCVSHICAVLTFYVPIITLAAMHHFAKHKSPLVVILIADMFLLVPPLMNPIVYCVKTRQIWEKILGIYCH

SEQ ID NO: 12561 - protein, 318 aa, Artificial Sequence
  Description of Artificial Sequence: Synthetic coding sequence
MSVLNNSEVKLFLLIGIPGLEHAHIWFSIPICLMYLLAIMGNCTILFIIKTEPSLHEPMYYFLAMLAVSDMGLSLSSLPTMLRVFLFNAMGISPNACFAQEFFIHGFTVMESSVLLIMSLDRFLAIHNPLRYSSILTSNRVAKMGLILAIRSILLVIPFPFTLRRLKYCQKNLLSHSYCLHQDTMKLACSDNKTNVIYGFFIALCTMLDLALIVLSYVLILKTILSIASLAERLKALNTCVSHICAVLTFYVPIITLAAMHHFAKHKSPLVVILIADMFLLVPPLMNPIVYCVKTRQIWEKILVTFRFIKTVKKFWKR

SEQ ID NO: 12562 - protein, 312 aa, Artificial Sequence
  Description of Artificial Sequence: Synthetic coding sequence
MWPNITAAPFLLTGFPGLEAAHHWISIPFFAVYVCILLGNGMLLYLIKHDHSLHEPMYYFLTMLAGTDLMVTLTTMPTVMGILWVNHREISSVGCFLQAYFIHSLSVVESGSLLAMAYDCFIAIRNPLRYASILTNTRVIALGVGVFLRGFVSILPVILRLFSFSYCKSHVITRAFCLHQEIMRLACADITFNRLYPVILISLTIFLDCLIILFSYILILNTVIGIASGEERAKALNTCISHISCVLIFYVTVMGLTFIYRFGKNVPEVVHIIMSYIYFLFPPLMNPVIYSIKTKQIQYGIIRLLSKHRFSS

SEQ ID NO: 12563 - protein, 310 aa, Artificial Sequence
  Description of Artificial Sequence: Synthetic coding sequence
MWYNNSAGPFLLTGFLGSEAVHYRISMSFFVIYFSVLFGNGTLLVLIWNDHSLHEPMYYFLAMLADTDLGMTFTTMPTVLGVLLLDQREIAHAACFTQSFIHSLAIVESGILLVLAYDCFIAIRTPLRYNCILTNSRVMNIGLGVLMRGFMSILPIILSLYCYPYCGSRALLHTFCLHQDVIKLACADITFNHIYPIIQTSLTVFLDALIIIFSYILILKTVMGIASGQEEAKSLNTCVSHISCVLVFHITVMGLSFIHRFGKHAPHVVPITMSYVHFLFPPFVNPIIYSIKTKQIQRSIIRLFSGQSRA

SEQ ID NO: 12564 - protein, 312 aa, Artificial Sequence
  Description of Artificial Sequence: Synthetic coding sequence
MSSSGSSHPFLLTGFPGLEEAHHWISVFFLFMYISILFGNGTLLLLIKEDHNLHEPMYFFLAMLAATDLGLALTTMPTVLGVLWLDHREIGSAACFSQAYFIHSLSFLESGILLAMAYDRFIAICNPLRYTSVLTNTRVVKIGLGVLMRGFVSVVPPIRPLYFFLYCHSHVLSHAFCLHQDVIKLACADTTFNRLYPAVLVVFIFVLDYLIIFISYVLILKTVLSIASREERAKALITCVSHICCVLVFYVTVIGLSLIHRFGKQVPHIVHLIMSYAYFLFPPLMNPITYSVKTKQIQNAILHLFTTHRIGT

SEQ ID NO: 12565 - protein, 312 aa, Artificial Sequence
  Description of Artificial Sequence: Synthetic coding sequence
MGLNKSASTFQLTGFPGMEKAHHWIFIPLLAAYISILLGNGTLLFLIRNDHNLHEPMYYFLAMLAATDLGVTLTTMPTVLGVLWLDHREIGHGACFSQAYFIHTLSVMESGVLLAMAYDCFITIRSPLRYTSILTNTQVMKIGVRVLTRAGLSIMPIVVRLHWFPYCRSHVLSHAFCLHQDVIKLACADITFNRLYPVVVLFAMVLLDFLIIFFSYILILKTVMGIGSGGERAKALNTCVSHICCILVFYVTVVCLTFIHRFGKHVPHVVHITMSYIHFLFPPFMNPFIYSIKTKQIQSGILRLFSLPHSRA

SEQ ID NO: 12566 - protein, 305 aa, Artificial Sequence
  Description of Artificial Sequence: Synthetic coding sequence
VSTSQSHDFLLTGFPGMEKAHHWIFIPLLAAYISILLGNGTLLFLIRNDHNLHEPMYYFLAMLAATDLGVTLTTMPTVLGVLWLDHREIGHGACFSQAYFIHTLSVMESGVLLAMAYDCFITIRSPLRYTSILTNTQVMKIGVRVLTRAGLSIMPIVVRLHWFPYCRSHVLSHAFCLHQDVIKLACADITFNRLYPVVVLFAMVLLDFLIIFFSYILILKTVMGIGSGGERAKALNTCVSHICCILVFYVTVVCLTFIHRFGKHVPHVVHITMSYIHFLFPPFMNPFIYSIKTKQIQSGILRLFS

SEQ ID NO: 12567 - protein, 312 aa, Artificial Sequence [sequence omitted]

SEQ ID NO: 12568 - protein, 324 aa, Artificial Sequence
  Description of Artificial Sequence: Synthetic coding sequence
MQKPQLLVPIIATSNGNLVHAAYFLLVGIPGLGPTIHFWLAFPLCFMYALATLGNLTIVLIIRVERRLHEPMYLFLAMLSTIDLVLSSITMPKMASLFLMGIQEIEFNICLAQMFLIHALSAVESAVLLAMAFDRFVAICHPLRHASVLTGCTVAKIGLSALTRGFVFFFPLPFILKWLSYCQTHTVTHSFCLHQDIMKLSCTDTRVNVVYGLFIILSVMGVDSLFIGFSYILILWAVLELSSRRAALKAFNTCISHLCAVLVFYVPLIGLSVVHRLGGPTSLLHVVMANTYLLLPPVVNPLVYGAKTKEICSRVLCMFSQGGK

SEQ ID NO: 12569 - protein, 318 aa, Artificial Sequence
  Description of Artificial Sequence: Synthetic coding sequence
MMVDPNGNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQMFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFHVATHASEP

SEQ ID NO: 12570 - protein, 320 aa, Artificial Sequence
  Description of Artificial Sequence: Synthetic coding sequence
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 12571 - protein, 83 aa, Artificial Sequence
  Description of Artificial Sequence: Synthetic coding sequence
MSSCNFTHATFVLIGIPGLEKAHFWVGFPLLSMYVVAMFGNCIVVFIVRTERSLHAPMYLFLCMLAAIDLALSTSTMPKILAL

SEQ ID NO: 12572 - protein, 342 aa, Artificial Sequence
  Description of Artificial Sequence: Synthetic coding sequence
MTETSLSSQCFPMSVLNNTIAEPLIFLLMGIPGLKATQYWISIPFCLLYVVAVSGNSMILFVVLCERSLHKPMYYFLSMLSATDLSLSLCTLSTTLGVFWFEAREINLNACIAQMFFLHGFTFMESGVLLAMAFDRFVAICYPLRYTTILTNARIAKIGMSMLIRNVAVMLPVMLFVKRLSFCSSMVLSHSYCYHVDLIQLSCTDNRINSILGLFALLSTTGFDCPCILLSYILIIRSVLSIASSEERRKAFNTCTSHISAVSIFYLPLISLSLVHRYGHSAPPFVHIIMANVFLLIPPVLNPIIYSVKIKQIQKAIIKVLIQKHSKSNHQLFLIRDKAIYE

SEQ ID NO: 12573 - protein, 321 aa, Artificial Sequence
  Description of Artificial Sequence: Synthetic coding sequence
MTILLNSSLQRATFFLTGFQGLEGLHGWISIPFCFIYLTVILGNLTILHVICTDATLHGPMYYFLGMLAVTDLGLCLSTLPTVLGIFWFDTREIGIPACFTQLFFIHTLSSMESSVLLSMSIDRYVAVCNPLHDSTVLTPACIVKMGLSSVLRSALLILPLPFLLKRFQYCHSHVLAHAYCLHLEIMKLACSSIIVNHIYGLFVVACTVGVDSLLIFLSYALILRTVLSIASHQERLRALNTCVSHICAVLLFYIPMIGLSLVHRFGEHLPRVVHLFMSYVYLLVPPLMNPIIYSIKTKQIRQRIIKKFQFIKSLRCFWKD

SEQ ID NO: 12574 - protein, 314 aa, Artificial Sequence
  Description of Artificial Sequence: Synthetic coding sequence
MTLGSLGNSSSSVSATFLLSGIPGLERMHIWISIPLCFMYLVSIPGNCTILFIIKTERSLHEPMYLFLSMLALIDLGLSLCTLPTVLGIFWVGAREISHDACFAQLFFIHCFSFLESSVLLSMAFDRFVAICHPLHYVSILTNTVIGRIGLVSLGRSVALIFPLPFMLKRFPYCGSPVLSHSYCLHQEVMKLACADMKANSIYGMFVIVSTVGIDSLLILFSYALILRTVLSIASRAERFKALNTCVSHICAVLLFYTPMIGLSVIHRFGKQAPHLVQVVMGFMYLLFPPVMNPIVYSVKTKQIRDRVTHAFCY

SEQ ID NO: 12575 - protein, 302 aa, Artificial Sequence
  Description of Artificial Sequence: Synthetic coding sequence
MTNLNASQANHRNFILTGIPGTPDKNPWLAFPLGFLYTLTLLGNGTILAVIKVEPSLHEPTYYFLSILALTDVSLSMSTLPSMLSIYWFNAPQIVFDACIMQMFFIHVFGIVESGVLVSMAFDRFVAIRNPLHYVSILTHDVIRKTGIAVLTRAVCVVFPVPFLIKCLPFCHSNVLSHSYCLHQNMMRLACASTRINSLYGLIVVIFTLGLDVLLTLLSYVLTLKTVLGIVSRGERLKTLSTCLSHMSTVLLFYVPFMGAASMIHRFWEHLSPVVHMVMADIYLLLPPVLNPIVYSVKTKQI

SEQ ID NO: 12576 - protein, 297 aa, Artificial Sequence
  Description of Artificial Sequence: Synthetic coding sequence
LTGIPGIQTGLTWVALIFCILYMISIVGNLSILTLVFWEPALHQPMYYFLSMLALNDLGVSFSTLPTVISTFCFNYNHVAFNACLVQMFFIHTFSFMESGILLAMSLDRFVAICYPLRYVTVLTHNRILAMGLGILTKSFTTLFPFPFVVKRLPFCKGNVLHHSYCLHPDLMKLPCADTKLNSILGLAIVLANFGLDSLLIVVSYVLILYTVMGIASGEGRWKALNTCVSHICAVLIYYVPMIGVSVMHRAAKHASPIVHTLMSSICLLVPPVLNPIIYSVKTQTIRQGILTLFSCK

SEQ ID NO: 12577 - protein, 311 aa, Artificial Sequence
  Description of Artificial Sequence: Synthetic coding sequence
GLRHSTHPATLQLTGIPGIQTGLTWVALIFCILYMISIVGNLSILTLVFWEPALHQPMYYFLSMLALNDLGVSFSTLPTVISTFCFNYNHVAFNACLVQMFFIHTFSFMESGILLAMSLDRFVAICYPLRYVTVLTHNRILAMGLGILTKSFTTLFPFPFVVKRLPFCKGNVLHHSYCLHPDLMKVACGDIHVNNIYGLLVIIFTYGMDSTFILLSYALILRAMLVIISQEQRLKALNTCMSHICAVLAFYVPIIAVSMIHRFWKSAPPVVHVMMSNVYLFVPPMLNPIIYSVKTKEIRKGILKFFHKSQA

SEQ ID NO: 12578 - protein, 314 aa, Artificial Sequence
  Description of Artificial Sequence: Synthetic coding sequence
MLGLNGTPFQPATLQLTGIPGIQTGLTWVALIFCILYMISIVGNLSILTLVFWEPALHQPMYYFLSMLALNDLGVSFSTLPTVISTFCFNYNHVAFNACLVQMFFIHTFSFMESGILLAMSLDRFVAICYPLRYVTVLTHNRILAMGLGILTKSFTTLFPFPFVVKRLPFCKGNVLHHSYCLHPDLMKVACGDIHVNNIYGLLVIIFTYGMDSTFILLSYALILRAMLVIISQEQRLKALNTCMSHICAVLAFYVPIIAVSMIHRFWKSAPPVVHVMMSNVYLFVPPMLNPIIYSVKTKEIRKGILKFFHKSQA

SEQ ID NO: 12579 - protein, 312 aa, Artificial Sequence
  Description of Artificial Sequence: Synthetic coding sequence
MGLFNVTHPAFFLLTGIPGLESSHSWLSGPLCVMYAVALGGNTVILQAVRVEPSLHEPMYYFLSMLSFSDVAISMATLPTVLRTFCLNARNITFDACLIQMFLIHFFSMMESGILLAMSFDRYVAICDPLRYATVLTTEVIAAMGLGAAARSFITLFPLPFLIKRLPICRSNVLSHSYCLHPDMMRLACADISINSIYGLFVLVSTFGMDLFFIFLSYVLILRSVMATASREERLKALNTCVSHILAVLAFYVPMIGVSTVHRFGKHVPCYIHVLMSNVYLFVPPVLNPLIYSAKTKEIRRAIFRMFHHIKI

SEQ ID NO: 12580 - protein, 316 aa, Artificial Sequence
  Description of Artificial Sequence: Synthetic coding sequence
MKISNNSLGFLPTTFILVGIPGLESEHLWISVPFSLIYIIIFLGNGIILHVIRTDIALHQPMYLFLAMLALAEVRVSASTLPTVLGIFLFGNTEISLEACLFPDVLHPFFIHDGASCAAGHVFGPLYSHLQPTELHSYPDTAQGLWHRSYYRTEKHYAHGSVAHSLMASALLWPQCPLTFLLSAPQSYLSCGNISVNNIYGIFIVTSTFGLDSLLIVISYGLILHTVLGIATGEGRKKALNTCGSHVCAVLAYYVPMIGLSIVHRLGHRVSPLLQAMMANAYLFFPPVVNPIVYSIKTKEIHGAIVRMLLEKRRRV

SEQ ID NO: 12581 - protein, 315 aa, Artificial Sequence
  Description of Artificial Sequence: Synthetic coding sequence
MGDWNNSDAVEPIFILRGFPGLEYVHSWLSILFCLAYLVAFMGNVTILSVIWIESSLHQPMYYFISILAVNDLGMSLSTLPTMLAVLWLDAPEIQASACYAQLFFIHTFTFLESSVLLAMAFDRFVAICHPLHYPTILTNSVIGKIGLACLLRSLGVVLPTPLLLRHYHYCHGNALSHAFCLHQDVLRLSCTDARTNSIYGLCVVIATLGVDSIFILLSYVLILNTVLDIASREEQLKALNTCVSHICVVLIFFVPVIGVSMVHRFGKHLSPIVHILMADIYLLLPPVLNPIVYSVRTKQIRLGILHKFVLRRRF

SEQ ID NO: 12582 - protein, 317 aa, Artificial Sequence
  Description of Artificial Sequence: Synthetic coding sequence
MSQVTNTTQEGIYFILTDIPGFEASHIWISIPVCCLYTISIMGNTTILTVIRTEPSVHQRMYLFLSMLALTDLGLTLTTLPTVMQLLWFNVRRISSEACFAQFFFLHGFSFMESSVLLAMSVDCYVAICCPLHYASILTNEVIGRTGLAIICCCVLAVLPSLFLLKRLPFCHSHLLSRSYCLHQDMIRLVCADIRLNSWYGFALALLIIIVDPLLIVISYTLILKNILGTATWAERLRALNNCLSHILAVLVLYIPMVGVSMTHRFAKHASPLVHVIMANIYLLAPPVMNPIIYSVKNKQIQWGMLNFLSLKNMHSR

SEQ ID NO: 12583 - protein, 323 aa, Artificial Sequence
  Description of Artificial Sequence: Synthetic coding sequence
MSTLPTQIAPNSSTSMAPTFLLVGMPGLSGAPSWWTLPLIAVYLLSALGNGTILWIIALQPALHRPMHFFLFLLSVSDIGLVTALMPTLLGIALAGAHTVPASACLLQMVFIHVFSVMESSVLLAMSIDRALAICRPLHYPALLTNGVISKISLAISFRCLGLHLPLPFLLAYMPYCLPQVLTHSYCLHPDVARLACPEAWGAAYSLFVVLSAMGLDPLLIFFSYGLIGKVLQGVESREDRWKAGQTCAAHLSAVLLFYIPMILLALINHPELPITQHTHTLLSYVHFLLPPLINPILYSVKMKEIRKRILNRLQPRKVGGAQ

SEQ ID NO: 12584 - protein, 327 aa, Artificial Sequence
  Description of Artificial Sequence: Synthetic coding sequence
MAIFNNTTSSSSNFLLTAFPGLECAHVWISIPVCCLYTIALLGNSMIFLVIITKRRLHKPMYYFLSMLAAVDLCLTITTLPTVLGVLWFHAREISFKACFIQMFFVHAFSLLESSVLVAMAFDRFVAICNPLNYATILTDRMVLVIGLVICIRPAVFLLPLLVAINTVSFHGGHELSHPFCYHPEVIKYTYSKPWISSFWGLFLQLYLNGTDVLFILFSYVLILRTVLGIVARKKQQKALSTCVCHICAVTIFYVPLISLSLAHRLFHSTPRVLCSTLANIYLLLPPVLNPIIYSLKTKTIRQAMFQLLQSKGSWGFNVRGLRGRWD

SEQ ID NO: 12585 - protein, 354 aa, Artificial Sequence
  Description of Artificial Sequence: Synthetic coding sequence
MTNKMYAIYIKNLNYFSFLIVQCLQPTMAIFNNTTSSSSNFLLTAFPGLECAHVWISIPVCCLYTIALLGNSMIFLVIITKRRLHKPMYYFLSMLAAVDLCLTITTLPTVLGVLWFHAREISFKACFIQMFFVHAFSLLESSVLVAMAFDRFVAICNPLNYATILTDRMVLVIGLVICIRPAVFLLPLLVAINTVSFHGGHELSHPFCYHPEVIKYTYSKPWISSFWGLFLQLYLNGTDVLFILFSYVLILRTVLGIVARKKQQKALSTCVCHICAVTIFYVPLISLSLAHRLFHSTPRVLCSTLANIYLLLPPVLNPIIYSLKTKTIRQAMFQLLQSKGSWGFNVRGLRGRWD

SEQ ID NO: 12586 - protein, 321 aa, Artificial Sequence
  Description of Artificial Sequence: Synthetic coding sequence
MFLSSRMITSVSPSTSTNSSFLLTGFSGMEQQYPWLSIPFSSIYAMVLLGNCMVLHVIWTEPSLHQPMFYFLSMLALTDLCMGLSTVYTVLGILWGIIREISLDSCIAQSYFIHGLSFMESSVLLTMAFDRYIAICNPLRYSSILTNSRIIKIGLTIIGRSFFFITPPIICLKFFNYCHFHILSHSFCLHQDLLRLACSDIRFNSYYALMLVICILLLDAILILFSYILILKSVLAVASQEERHKLFQTCISHICAVLVFYIPIISLTMVHRFGKHLSPVAHVLIGNIYILFPPLMNPIIYSVKTQQIHTRMLRLFSLKRY

SEQ ID NO: 12587 - protein, 312 aa, Artificial Sequence
  Description of Artificial Sequence: Synthetic coding sequence
MSISNITVYMPSVLTLVGIPGLESVQCWIGIPFCAIYLIAMIGNSLLLSIIKSERSLHEPLYIFLGMLGATDIALASSIMPKMLGIFWFNVPEIYFDSCLLQMWFIHTLQGIESGILVAMALDRYVAICYPLRHANIFTHQLVIQIGTMVVLRAAILVAPCLVLIKCRFQFYHTTVISHSYCEHMAIVKLAAANVQVNKIYGLFVAFTVAGFDLTFITLSYIQIFITVFRLPQKEARFKAFNTCIAHICVFLQFYLLAFFSFFTHRFGSHISPYIHILFSSIYLLVPPFLNPLVYGAKTTQIRIHVVKMFCS

SEQ ID NO: 12588 - protein, 312 aa, Artificial Sequence; identical to SEQ ID NO: 12587
  Description of Artificial Sequence: Synthetic coding sequence

SEQ ID NO: 12589 - protein, 316 aa, Artificial Sequence
  Description of Artificial Sequence: Synthetic coding sequence
MPTFNGSVFMPSAFILIGIPGLESVQCWIGIPFSAMYLIGVIGNSLILVIIKYENSLHIPMYIFLAMLAATDIALNTCILPKMLGIFWFHLPEISFDACLFQMWLIHSFQAIESGILLAMALDRYVAICIPLRHATIFSQQFLTHIGLGVTLRAAILIIPSLGLIKCCLKHYRTTVISHSYCEHMAIVKLATEDIRVNKIYGLFVAFAILGFDIIFITLSYVQIFITVFQLPQKEARFKAFNTCIAHICVFLQFYLLAFFSFFTHRFGSHIPPYIHILLSNLYLLVPPFLNPIVYGVKTKQIRDHIVKVFFFKKVT

SEQ ID NO: 12590 - protein, 323 aa, Artificial Sequence
  Description of Artificial Sequence: Synthetic coding sequence
MSHTNVTIFHPAVFVLPGIPGLEAYHIWLSIPLCLIYITAVLGNSILIVVIVMERNLHVPMYFFLSMLAVMDILLSTTTVPKALAIFWLQAHNIAFDACVTQGFFVHMMFVGESAILLAMAFDRFVAICAPLRYTTVLTWPVVGRIALAVITRSFCIIFPVIFLLKRLPFCLTNIVPHSYCEHIGVARLACADITVNIWYGFSVPIVMVILDVILIAVSYSLILRAVFRLPSQDARHKALSTCGSHLCVILMFYVPSFFTLLTHHFGRNIPQHVHILLANLYVAVPPMLNPIVYGVKTKQIREGVAHRFFDIKTWCCTSPLGS

SEQ ID NO: 12591 - protein, 314 aa, Artificial Sequence
  Description of Artificial Sequence: Synthetic coding sequence
MPTVNHSGTSHTVFHLLGIPGLQDQHMWISIPFFISYVTALLGNSLLIFIILTKRSLHEPMYLFLCMLAGADIVLSTCTIPQALAIFWFRAGDISLDRCITQLFFIHSTFISESGILLVMAFDHYIAICYPLRYTTILTNALIKKICVTVSLRSYGTIFPIIFLLKRLTFCQNNIIPHTFCEHIGLAKYACNDIRINIWYGFSILMSTVVLDVVLIFISYMLILHAVFHMPSPDACHKALNTFGSHVCIIILFYGSGIFTILTQRFGRHIPPCIHIPLANVCILAPPMLNPIIYGIKTKQIQEQVVQFLFIKQK

SEQ ID NO: 12592 - protein, 335 aa, Artificial Sequence
  Description of Artificial Sequence: Synthetic coding sequence
MAQVRALHKIMALFSANSIGAMNNSDTRIAGCFLTGIPGLEQLHIWLSIPFCIMYITALEGNGILICVILSQAILHEPMYIFLSMLASADVLLSTTTMPKALANLWLGYSLISFDGCLTQMFFIHFLFIHSAVLLAMAFDRYVAICSPLRYVTILTSKVIGKIVTAALSHSFIIMFPSIFLLEHLHYCQINIIAHTFCEHMGIAHLSCSDISINVWYGLAAALLSTGLDIMLITVSYIHILQAVFRLLSQDARSKALSTCGSHICVILLFYVPALFSVFAYRFGGRSVPCYVHILLASLYVVIPPMLNPVIYGVRTKPILEGAKQMFSNLAKGSK

SEQ ID NO: 12593 - protein, 318 aa, Artificial Sequence
  Description of Artificial Sequence: Synthetic coding sequence
MSDSNLSDNHLPDTFFLTGIPGLEAAHFWIAIPFCAMYLVALVGNAALILVIAMDNALHAPMYLFLCLLSLTDLALSSTTVPKMLAILWLHAGEISFGGCLAQMFCVHSIYALESSILLAMAFDRYVAICNPLRYTTILNHAVIGRIGFVGLFRSVAIVSPFIFLLRRLPYCGHRVMTHTYCEHMGIARLACANITVNIVYGLTVALLAMGLDSILIAISYGFILHAVFHLPSHDAQHKALSTCGSHIGIILVFYIPAFFSFLTHRFGHHEVPKHVHIFLANLYVLVPPVLNPILYGARTKEIRSRLLKLLHLGKTSI

SEQ ID NO: 12594 - protein, 325 aa, Artificial Sequence
  Description of Artificial Sequence: Synthetic coding sequence
MFLPNDTQFHPSSFLLLGIPGLETLHIWIGFPFCAVYMIALIGNFTILLVIKTDSSLHQPMFYFLAMLATTDVGLSTATIPKMLGIFWINLRGIIFEACLTQMFFIHNFTLMESAVLVAMAYDSYVAICNPLQYSAILTNKVVSVIGLGVFVRALIFVIPSILLILRLPFCGNHVIPHTYCEHMGLAHLSCASIKINIIYGLCAICNLVFDITVIALSYVHILCAVFRLPTHEARLKSLSTCGSHVCVILAFYTPALFSFMTHRFGRNVPRYIHILLANLYVVVPPMLNPVIYGVRTKQIYKCVKKILLQEQGMEKEEYLIHTRF

SEQ ID NO: 12595 - protein, 312 aa, Artificial Sequence
  Description of Artificial Sequence: Synthetic coding sequence
MPSINDTHFYPPFFLLLGIPGLDTLHIWISFPFCIVYLIAIVGNMTILFVIKTEHSLHQPMFYFLAMLSMIDLGLSTSTIPKMLGIFWFNLQEISFGGCLLQMFFIHMFTGMETVLLVVMAYDRFVAICNPLQYTMILTNKTISILASVVVGRNLVLVTPFVFLILRLPFCGHNIVPHTYCEHRGLAGLACAPIKINIIYGLMVISYIIVDVILIASSYVLILRAVFRLPSQDVRLKAFNTCGSHVCVMLCFYTPAFFSFMTHRFGQNIPHYIHILLANLYVVVPPALNPVIYGVRTKQIREQIVKIFVQKE

SEQ ID NO: 12596 - protein, 313 aa, Artificial Sequence
  Description of Artificial Sequence: Synthetic coding sequence
MPIANDTQFHTSSFLLLGIPGLEDVHIWIGFPFFSVYLIALLGNAAIFFVIQTEQSLHEPMYYCLAMLDSIDLSLSTATIPKMLGIFWFNIKEISFGGYLSQMFFIHFFTVMESIVLVAMAFDRYIAICKPLWYTMILTSKIISLIAGIAVLRSLYMVIPLVFLLLRLPFCGHRIIPHTYCEHMGIARLACASIKVNIMFGLGSISLLLLDVLLIILSHIRILYAVFCLPSWEARLKALNTCGSHIGVILAFSTPAFFSFFTHCFGHDIPQYIHIFLANLYVVVPPTLNPVIYGVRTKHIRETVLRIFFKTDH

SEQ ID NO: 12597 - protein, 317 aa, Artificial Sequence
  Description of Artificial Sequence: Synthetic coding sequence
MEKRMPIANDTQFHTSSFLLLGIPGLEDVHIWIGFPFFSVYLIALLGNAAIFFVIQTEQSLHEPMYYCLAMLDSIDLSLSTATIPKMLGIFWFNIKEISFGGYLSQMFFIHFFTVMESIVLVAMAFDRYIAICKPLWYTMILTSKIISLIAGIAVLRSLYMVIPLVFLLLRLPFCGHRIIPHTYCEHMGIARLACASIKVNIMFGLGSISLLLLDVLLIILSHIRILYAVFCLPSWEARLKALNTCGSHIGVILAFSTPAFFSFFTHCFGHDIPQYIHIFLANLYVVVPPTLNPVIYGVRTKHIRETVLRIFFKTDH

SEQ ID NO: 12598 - protein, 317 aa, Artificial Sequence
  Description of Artificial Sequence: Synthetic coding sequence
MAGRMSTSNHTQFHPSSFLLLGIPGLEDVHIWIGVPFFFVYLVALLGNTALLFVIQTEQSLHEPMYYFLAMLDSIDLGLSTATIPKMLGIFWFNTKEISFGGCLSHMFFIHFFTAMESIVLVAMAFDRYIAICKPLRYTMILTSKIISLIAGIAVLRSLYMVVPLVFLLLRLPFCGHRIIPHTYCEHMGIARLACASIKVNIRFGLGNISLLLLDVILIILSYVRILYAVFCLPSWEARLKALNTCGSHIGVILAFFTPAFFSFLTHRFGHNIPQYIHIILANLYVVVPPALNPVIYGVRTKQIRERVLRIFLKTNH

SEQ ID NO: 12599 - protein, 320 aa, Artificial Sequence
  Description of Artificial Sequence: Synthetic coding sequence
MPSASAMIIFNLSSYNPGPFILVGIPGLEQFHVWIGIPFCIIYIVAVVGNCILLYLIVVEHSLHEPMFFFLSMLAMTDLILSTAGVPKALSIFWLGAREITFPGCLTQMFFLHYNFVLDSAILMAMAFDHYVAICSPLRYTTILTPKTIIKSAMGISFRSFCIILPDVFLLTCLPFCRTRIIPHTYCEHIGVAQLACADISINFWYGFCVPIMTVISDVILIAVSYAHILCAVFGLPSQDACQKALGTCGSHVCVILMFYTPAFFSILAHRFGHNVSRTFHIMFANLYIVIPPALNPMVYGVKTKQIRDKVILLFSKGTG

SEQ ID NO: 12600 - protein, 348 aa, Artificial Sequence
  Description of Artificial Sequence: Synthetic coding sequence
TQVPKDCTILLHHLYINRQEVSPVMLGPAYNHTMETPASFLLVGIPGLQSSHLWLAISLSAMYITALLGNTLIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAVTIRAVTFMTPLSWMMNHLPFCGSNVVVHSYCKHIALARLACADPVPSSLYSLIGSSLMVGSDVAFIAASYILILRAVFDLSSKTAQLKALSTCGSHVGVMALYYLPGMASIYAAWLGQDIVPLHTQVLLADLYVIIPATLNPIIYGMRTKQLLEGIWSYLMHFLFDHSNLGS

SEQ ID NO: 12601 - protein, 324 aa, Artificial Sequence
  Description of Artificial Sequence: Synthetic coding sequence
MLGPAYNHTMETPASFLLVGIPGLQSSHLWLAISLSAMYITALLGNTLIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAVTIRAVTFMTPLSWMMNHLPFCGSNVVVHSYCKHIALARLACADPVPSSLYSLIGSSLMVGSDVAFIAASYILILRAVFDLSSKTAQLKALSTCGSHVGVMALYYLPGMASIYAAWLGQDIVPLHTQVLLADLYVIIPATLNPIIYGMRTKQLLEGIWSYLMHFLFDHSNLGS

SEQ ID NO: 12602 - protein, 350 aa, Artificial Sequence
  Description of Artificial Sequence: Synthetic coding sequence
MCQQILRDCILLIHHLCINRKKVSLVMLGPAYNHTMETPASFLLVGIPGLQSSHLWLAISLSAMYIIALLGNTIIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAITIRAIIAITPLSWMVSHLPFCGSNVVVHSYCEHIALARLACADPVPSSLYSLIGSSLMVGSDVAFIAASYILILKAVFGLSSKTAQLKALSTCGSHVGVMALYYLPGMASIYAAWLGQDVVPLHTQVLLADLYVIIPATLNPIIYGMRTKQLRERIWSYLMHVLFDHSNLGS

SEQ ID NO: 12603 - protein, 311 aa, Artificial Sequence
  Description of Artificial Sequence: Synthetic coding sequence
MFYHNKSIFHPVTFFLIGIPGLEDFHMWISGPFCSVYLVALLGNATILLVIKVEQTLREPMFYFLAILSTIDLALSTTSVPRMLGIFWFDAHEINYGACVAQMFLIHAFTGMEAEVLLAMAFDRYVAVCAPLHYATILTSQVLVGISMCIVIRPVLLTLPMVYLIYRLPFCQAHIIAHSYCEHMGIAKLSCGNIRINGIYGLFVVSFFVLNLVLIGISYVYILRAVFRLPSHDAQLKALSTCGAHVGVICVFYIPSVFSFLTHRFGHQIPGYIHILVANLYLIIPPSLNPIIYGVRTKQIRERVLYVFTKK

SEQ ID NO: 12604 - protein, 314 aa, Artificial Sequence
  Description of Artificial Sequence: Synthetic coding sequence
MLPSNITSTHPAVFLLVGIPGLEHLHAWISIPFCFAYTLALLGNCTLLFIIQADAALHEPMYLFLAMLATIDLVLSSTTLPKMLAIFWFRDQEINFFACLVQMFFLHSFSIMESAVLLAMAFDRYVAICKPLHYTTVLTGSLITKIGMAAVARAVTLMTPLPFLLRRFHYCRGPVIAHCYCEHMAVVRLACGDTSFNNIYGIAVAMFIVVLDLLFVILSYVFILQAVLQLASQEARYKAFGTCVSHIGAILSTYTPVVISSVMHRVARHAAPRVHILLAIFYLLFPPMVNPIIYGVKTKQIREYVLSLFQRKNM

SEQ ID NO: 12605 - protein, 314 aa, Artificial Sequence
  Description of Artificial Sequence: Synthetic coding sequence
MSASNITLTHPTAFLLVGIPGLEHLHIWISIPFCLAYTLALLGNCTLLLIIQADAALHEPMYLFLAMLAAIDLVLSSSALPKMLAIFWFRDREINFFACLAQMFFLHSFSIMESAVLLAMAFDRYVAICKPLHYTKVLTGSLITKIGMAAVARAVTLMTPLPFLLRCFHYCRGPVIAHCYCEHMAVVRLACGDTSFNNIYGIAVAMFIVVLDLLLVILSYIFILQAVLLLASQEARYKAFGTCVSHIGAILAFYTTVVISSVMHRVARHAAPHVHILLANFYLLFPPMVNPIIYGVKTKQIRESILGVFPRKDM

SEQ ID NO: 12606 - protein, 329 aa, Artificial Sequence
  Description of Artificial Sequence: Synthetic coding sequence
MTLVSFFSFLSKPLIMLLSNSSWRLSQPSFLLVGIPGLEESQHWIALPLGILYLLALVGNVTILFIIWMDPSLHQSMYLFLSMLAAIDLVLASSTAPKALAVLLVHAHEIGYIVCLIQMFFIHAFSSMESGVLVAMALDCYVAICHPLHHSTILHPGVIGCIGMVVLVRGLLLLIPFPILLGKLIFCQATIIGHAYCEHMAVVKLACSETTVNRAYGLTMALLVIGLDVLAIGVSYAHILQAVLKVPGSEARLKAFSTCGSHICVILVFYVPGIFSFLTHRFGHHVPHHVHVLLATWYLLMPPALNPLVYGVKTQQIRQRVLRVFTQKD

SEQ ID NO: 12607 - protein, 317 aa, Artificial Sequence
  Description of Artificial Sequence: Synthetic coding sequence
MLTFHNVCSVPSSFWLTGIPGLESLHVWLSIPFGSMYLVAVVGNVTILAVVKIERSLHQPMYFFLCMLAAIDLVLSTSTIPKLLGIFWFGACDIGLDACLGQMFLIHCFATVESGIFLAMAFDRYVAICNPLRHSMVLTYTVVGRLGLVSLLRGVLYIGPLPLMIRLRLPLYKTHVISHSYCEHMAVVALTCGDSRVNNVYGLSIGFLVLILDSVAIAASYVMIFRAVMGLATPEARLKTLGTCASHLCAILIFYVPIAVSSLIHRFGQCVPPPVHTLLANFYLLIPPILNPIVYAVRTKQIRESLLQIPRIEMKIR

SEQ ID NO: 12608 - protein, 320 aa, Artificial Sequence
  Description of Artificial Sequence: Synthetic coding sequence
MSFLNGTSLTPASFILNGIPGLEDVHLWISFPLCTMYSIAITGNFGLMYLIYCDEALHRPMYVFLALLSFTDVLMCTSTLPNTLFILWFNLKEIDFKACLAQMFFVHTFTGMESGVLMLMALDHCVAICFPLRYATILTNSVIAKAGFLTFLRGVMLVIPSTFLTKRLPYCKGNVIPHTYCDHMSVAKISCGNVRVNAIYGLIVALLIGGFDILCITISYTMILQAVVSLSSADARQKAFSTCTAHFCAIVLTYVPAFFTFFTHHFGGHTIPLHIHIIMANLYLLMPPTMNPIVYGVKTRQVRESVIRFFLKGKDNSHNF

SEQ ID NO: 12609 - protein, 321 aa, Artificial Sequence
  Description of Artificial Sequence: Synthetic coding sequence
MSGDNSSSLTPGFFILNGVPGLEATHIWISLPFCFMYIIAVVGNCGLICLISHEEALHRPMYYFLALLSFTDVTLCTTMVPNMLCIFWFNLKEIDFNACLAQMFFVHMLTGMESGVLMLMALDRYVAICYPLRYATILTNPVIAKAGLATFLRNVMLIIPFTLLTKRLPYCRGNFIPHTYCDHMSVAKVSCGNFKVNAIYGLMVALLIGVFDICCISVSYTMILQAVMSLSSADARHKAFSTCTSHMCSIVITYVAAFFTFFTHRFVGHNIPNHIHIIVANLYLLLPPTMNPIVYGVKTKQIQEGVIKFLLGDKVSFTYDK

SEQ ID NO: 12610 - protein, 321 aa, Artificial Sequence
  Description of Artificial Sequence: Synthetic coding sequence
MLTLNKTDLIPASFILNGVPGLEDTQLWISFPFCSMYVVAMVGNCGLLYLIHYEDALHKPMYYFLAMLSFTDLVMCSSTIPKALCIFWFHLKDIGFDECLVQMFFTHTFTGMESGVLMLMALDRYVAICYPLRYSTILTNPVIAKVGTATFLRGVLLIIPFTFLTKLLPYCRGNILPHTYCDHMSVAKLSCGNVKVNAIYGLMVALLIWGFDILCITNSYTMILRAVVSLSSADARQKAFNTCTAHICAIVFSYTPAFFSFFSHRFGEHIIPPSCHIIVANIYLLLPPTMNPIVYGVKTKQIRDCVIRILSGSKDTKSYSM

SEQ ID NO: 12611 - protein, 324 aa, Artificial Sequence
  Description of Artificial Sequence: Synthetic coding sequence
MPLFNSLCWFPTIHVTPPSFILNGIPGLERVHVWISLPLCTMYIIFLVGNLGLVYLIYYEESLHHPMYFFFGHALSLIDLLTCTTTLPNALCIFWFSLKEINFNACLAQMFFVHGFTGVESGVLMLMALDRYVAICYPLRYATTLTNPIIAKAELATFLRGVLLMIPFPFLVKRLPFCQSNIISHTYCDHMSVVKLSCASIKVNVIYGLMVALLIGVFDICCISLSYTLILKAAISLSSSDARQKAFSTCTAHISAIIITYVPAFFTFFAHRFGGHTIPPSLHIIVANLYLLLPPTLNPIVYGVKTKQIRKSVIKFFQGDKGAG

SEQ ID NO: 12612 - protein, 315 aa, Artificial Sequence
  Description of Artificial Sequence: Synthetic coding sequence
MVLASGNSSSHPVSFILLGIPGLESFQLWIAFPFCATYAVAVVGNITLLHVIRIDHTLHEPMYLFLAMLAITDLVLSSSTQPKMLAIFWFHAHEIQYHACLIQVFFIHAFSSVESGVLMAMALDCYVAICFPLRHSSILTPSVVIKLGTIVMLRGLLWVSPFCFMVSRMPFCQHQAIPQSYCEHMAVLKLVCADTSISRGNGLFVAFSVAGFDMIVIGMSYVMILRAVLQLPSGEARLKAFSTRSSHICVILALYIPALFSFLTYRFGHDVPRVVHILFANLYLLIPPMLNPIIYGVRTKQIGDRVIQGCCGNIP

SEQ ID NO: 12613 - protein, 394 aa, Artificial Sequence
  Description of Artificial Sequence: Synthetic coding sequence
MFYPILNDISTKNNSNIMSCCNILFIKTVEIILVYNQTQSPWYPIVPSKSLVYNNNTCFDCYHLQRVDCVPSRDHINQSMVLASGNSSSHPVSFILLGIPGLESFQLWIAFPFCATYAVAVVGNITLLHVIRIDHTLHEPMYLFLAMLAITDLVLSSSTQPKMLAIFWFHAHEIQYHACLIQVFFIHAFSSVESGVLMAMALDCYVAICFPLRHSSILTPSVVIKLGTIVMLRGLLWVSPFCFMVSRMPFCQHQAIPQSYCEHMAVLKLVCADTSISRGNGLFVAFSVAGFDMIVIGMSYVMILRAVLQLPSGEARLKAFSTRSSHICVILALYIPALFSFLTYRFGHDVPRVVHILFANLYLLIPPMLNPIIYGVRTKQIGDRVIQGCCGNIP

SEQ ID NO: 12614 - protein, 320 aa, Artificial Sequence
  Description of Artificial Sequence: Synthetic coding sequence
MAETLQLNSTFLHPNFFILTGFPGLGSAQTWLTLVFGPIYLLALLGNGALPAVVWIDSTLHQPMFLLLAILAATDLGLATSIAPGLLAVLWLGPRSVPYAVCLVQMFFVHALTAMESGVLLAMACDRAAAIGRPLHYPVLVTKACVGYAALALALKAVAIVVPFPLLVAKFEHFQAKTIGHTYCAHMAVVELVVGNTQATNLYGLALSLAISGMDILGITGSYGLIAHAVLQLPTREAHAKAFGTCSSHICVILAFYIPGLFSYLTHRFGHHTVPKPVHILLSNIYLLLPPALNPLIYGARTKQIRDRLLETFTFRKSPL

SEQ ID NO: 12615 - protein, 318 aa, Artificial Sequence
  Description of Artificial Sequence: Synthetic coding sequence
MIQPMASPSNSSTVPVSEFLLICFPNFQSWQHWLSLPLSLLFLLAMGANTTLLITIQLEASLHQPLYYLLSLLSLLDIVLCLTVIPKVLAIFWYDLRSISFPACFLQMFIMNSFLPMESCTFMVMAYDRYVAICHPLRYPSIITNQFVAKASVFIVVRNALLTAPIPILTSLLHYCGENVIENCICANLSVSRLSCDNFTLNRIYQFVAGWTLLGSDLFLIFLSYTFILRAVLRFKAEGAAVKALSTCGSHFILILFFSTILLVVVLTNVARKKVPMDILILLNVLHHLIPPALNPIVYGVRTKEIKQGIQKLLQRGR

SEQ ID NO: 12616 - protein, 315 aa, Artificial Sequence
  Description of Artificial Sequence: Synthetic coding sequence
MTTHRNDTLSTEASDFLLNCFVRSPSWQHWLSLPLSLLFLLAVGANTTLLMTIWLEASLHQPLYYLLSLLSLLDIVLCLTVIPKVLTIFWFDLRPISFPACFLQMYIMNCFLAMESCTFMVMAYDRYVAICHPLRYPSIITDHFVVKAAMFILTRNVLMTLPIPILSAQLRYCGRNVIENCICANMSVSRLSCDDVTINHLYQFAGGWTLLGSDLILIFLSYTFILRAVLRLKAEGAVAKALSTCGSHFMLILFFSTILLVFVLTHVAKKKVSPDVPVLLNVLHHVIPAALNPIIYGVRTQEIKQGMQRLLKKGC

SEQ ID NO: 12617 - protein, 365 aa, Artificial Sequence
  Description of Artificial Sequence: Synthetic coding sequence
MMTVILKTLLGQIQGLSGNPHSTTSRMYFLCFCTSLLRFKVHWVSRLIRKLYMASPSNDSTAPVSEFLLICFPNFQSWQHWLSLPLSLLFLLAMGANTTLLITIQLEASLHQPLYYLLSLLSLLDIVLCLTVIPKVLAIFWFDLRSISFPACFLQMFIMNSFLTMESCTFMVMAYDRYVAICHPLRYPSIITDQFVARAVVFVIARNAFVSLPVPMLSARLRYCAGNIIKNCICSNLSVSKLSCDDITFNQLYQFVAGWTLLGSDLILIVISYSFILKVVLRIKAEGAVAKALSTCGSHFILILFFSTVLLVLVITNLARKRIPPDVPILLNILHHLIPPALNPIVYGVRTKEIKQGIQNLLKRL

SEQ ID NO: 12618 - protein, 324 aa, Artificial Sequence
  Description of Artificial Sequence: Synthetic coding sequence
MNHMSASLKISNSSKFQVSEFILLGFPGIHSWQHWLSLPLALLYLSALAANTLILIIIWQNPSLQQPMYIFLGILCMVDMGLATTIIPKILAIFWFDAKVISLPECFAQIYAIHFFVGMESGILLCMAFDRYVAICHPLRYPSIVTSSLILKATLFMVLRNGLFVTPVPVLAAQRDYCSKNEIEHCLCSNLGVTSLACDDRRPNSICQLVLAWLGMGSDLSLIILSYILILYSVLRLNSAEAAAKALSTCSSHLTLILFFYTIVVVISVTHLTEMKATLIPVLLNVLHNIIPPSLNPTVYALQTKELRAAFQKVLFALTKEIRS

SEQ ID NO: 12619 - protein, 319 aa, Artificial Sequence
  Description of Artificial Sequence: Synthetic coding sequence
MDTSTSVTYDSSLQISQFILMGLPGIHEWQHWLSLPLTLLYLLALGANLLIIITIQHETVLHEPMYHLLGILAVVDIGLATTIMPKILAIFWFDAKAISLPMCFAQIYAIHCFFCIESGIFLCMAVDRYIAICRPLQYPSIVTKAFVFKATGFIMLRNGLLTIPVPILAAQRHYCSRNEIEHCLCSNLGVISLACDDITVNKFYQLMLAWVLVGSDMALVFSSYAVILHSVLRLNSAEAMSKALSTCSSHLILILFHTGIIVLSVTHLAEKKIPLIPVFLNVLHNVIPPALNPLACALRMHKLRLGFQRLLGLGQDVSK

SEQ ID NO: 12620 - protein, 327 aa, Artificial Sequence
  Description of Artificial Sequence: Synthetic coding sequence
MEWRNHSGRVSEFVLLGFPAPAPLQVLLFALLLLAYVLVLTENTLIIMAIRNHSTLHKPMYFFLANMSFLEIWYVTVTIPKMLAGFVGSKQDHGQLISFEGCMTQLYFFLGLGCTECVLLAVMAYDRYMAICYPLHYPVIVSGRLCVQMAAGSWAGGFGISMVKVFLISGLSYCGPNIINHFFCDVSPLLNLSCTDMSTAELTDFILAIFILLGPLSVTGASYVAITGAVMHIPSAAGRYKAFSTCASHLTVVIIFYAASIFIYARPKALSAFDTNKLVSVLYAVIVPLLNPIIYCLRNQEVKRALCCTLHLYQHQDPDPKKASRNV

SEQ ID NO: 12621 - protein, 311 aa, Artificial Sequence
  Description of Artificial Sequence: Synthetic coding sequence
MELENQTRVTKFILVGFPGSLSMRAAMFLIFLVAYILTVAENVIIILLVLQNRPLHKPMYFFLANLSFLETWYISVTVPKLLFSFWSVNNSISFTLCMIQLYFFIALMCTECVLLAAMAYDRYVAICRPLHYPTIMSHGLCFRLALGSWAIGFGISLAKIYFISCLSFCGPNVINHFFCDISPVLNLSCTDMSITELVDFILALVIFLFPLFITVLSYGCILATILCMPTGKQKAFSTCASHLVVVTIFYSAIIFMYARPRVIHAFNMNKIISIFYAIVTPSLNPFIYCLRNREVKEALKKLAYCQASRSD

SEQ ID NO: 12622 - protein, 312 aa, Artificial Sequence
  Description of Artificial Sequence: Synthetic coding sequence
MSGENVTKVSTFILVGLPTAPGLQYLLFLLFLLTYLFVLVENLAIILIVWSSTSLHRPMYYFLSSMSFLEIWYVSDITPKMLEGFLLQQKRISFVGCMTQLYFFSSLVCTECVLLASMAYDRYVAICHPLRYHVLVTPGLCLQLVGFSFVSGFTISMIKVCFISSVTFCGSNVLNHFFCDISPILKLACTDFSTAELVDFILAFIILVFPLLATILSYWHITLAVLRIPSATGCWRAFSTCASHLTVVTVFYTALLFMYVRPQAIDSQSSNKLISAVYTVVTPIINPLIYCLRNKEFKDALKKALGLGQTSH

SEQ ID NO: 12623 - protein, 331 aa, Artificial Sequence
  Description of Artificial Sequence: Synthetic coding sequence
MSGENVTRVGTFILVGFPTAPGLQYLLFLLFLLTYLFVLVENLAIILTVWSSTSLHRPMYYFLSSMSFLEIWYVSDITPKMLEGFLLQQKRISFVGCMTQLYFFSSLVCTECVLLASMAYDRYVAICHPLRYHVLVTPGLCLQLVGFSFVSGFTISMIKVCFISSVTFCGSNVLNHFFCDISPILKLACTDFSTAELVDFILAFIILVFPLLATMLSYAHITLAVLRIPSATGCWRAFFTCASHLTVVTVFYTALLFMYVRPQAIDSRSSNKLISVLYTVITPILNPLIYCLRNKEFKNALKKAFGLTSCAVEGRLSSLLELHLQIHSQPL

SEQ ID NO: 12624 - protein, 312 aa, Artificial Sequence
  Description of Artificial Sequence: Synthetic coding sequence
MRNHTEITEFILLGLTDDPNFQVVIFVFLLITYMLSITGNLTLITITLLDSHLQTPMYFFLRNFSILEISFTTVSIPKFLGNIISGDKTISFNNCIVQLFFFILLGVTEFYLLAAMSYDRYVAICKPLHCLSIMNRRVCTLLVFTSWLVSFLIIFPALMLLLKLHYCRSNIIDHFTCDYFPLLQLACSDTKFLEVMGFSCAAFTLMFTLALIFLSYIYIIRTILRIPSTSQRTKAFSTCSSHMVVVSISYGSCIFMYIKPSAKDRVSLSKGVAILNTSVAPMMNPFIYSLRNQQVKQAFINMARKTVFFTST

SEQ ID NO: 12625 - protein, 312 aa, Artificial Sequence
  Description of Artificial Sequence: Synthetic coding sequence
MKNHTVIRTFILLGLTGDPHLQVLLFIFLFLTYMLSVTGNLTIITLTLVDHHLKTPMYFFLRNFSFLEVSFTTVCIPRFLYNISMGDNTITYNACASQIFFVILFGATEFFLLAAMSYDRYVAICKPLHYVVIMNNRVCTLLVLCCWVAGLMIIVPPLSLGLQLEFCDSNAIDHFSCDAGPLLKISCSDTWVIEQMVILMAVFALIITLVCVILSYLYIVRTILKFPSVQQRKKAFSTCSSHMIVVSIAYGSCIFIYIKPSAKDEVAINKGVSVLTTSVAPLLNPFIYTLRNKQVKQAFSDSIKRIAFLSKK

SEQ ID NO: 12626 - protein, 311 aa, Artificial Sequence
  Description of Artificial Sequence: Synthetic coding sequence
MNHTMVTEFVLLGLSDDPDLQIVIFLFLFITYILSVTGNLTIITLTFVDSHLQTPMYFFLRNFSFLEISFTTVCIPRFLGAIITRNKTISYNNCAAQLFFFIFMGVTEFYILTAMSYDRYVAICKPLHYTSIMNRKLCTLLVLCAWLSGFLTIFPPLMLLLQLDYCASNVIDHFACDYFPLLQLSCSDTWLLEVIGFYFALVTLLFTLALVILSYMYIIRTILRIPSASQRKKAFSTCSSHMIVISISYGSCIFMYANPSAKEKASLTKGIAILNTSVAPMLNPFIYTLRNQQVKQAFKNVVHKVVFYANQ

SEQ ID NO: 12627 - protein, 309 aa, Artificial Sequence
  Description of Artificial Sequence: Synthetic coding sequence
MKNRTMFGEFILLGLTNQPELQVMIFIFLFLTYMLSILGNLTIITLTLLDPHLQTPMYFFLRNFSFLEISFTSIFIPRFLTSMTTGNKVISFAGCLTQYFFAIFLGATEFYLLASMSYDRYVAICKPLHYLTIMSSRVCIQLVFCSWLGGFLAILPPIILMTQVDFCVSNILNHYYCDYGPLVELACSDTSLLELMVILLAVVTLMVTLVLVTLSYTYIIRTILRIPSAQQRTKAFSTCSSHMIVISLSYGSCMFMYINPSAKEGGAFNKGIAVLITSVTPLLNPFIYTLRNQQVKQAFKDSVKKIVKL

SEQ ID NO: 12628 - protein, 312 aa, Artificial Sequence
  Description of Artificial Sequence: Synthetic coding sequence
MPNMTSIREFILLGFTDNPELQVVIFFFMLITYLLSVSGNMIIIMLTLSNIHLKTPMYFFLRNFSFLEISFTTVFIPRFLINIATGDTTISYNASMAQVFFLILLGSTEFFLLAVMSYDRYVAICKPLHYTTIMSNKVCNWLVISSWLAGFLIIFPPVIMGLQLDFCDSSTIDHFICDSSPMLLIACTDTQFLELMAFLLAVFTLMVTLALVVLSYTLILKTILKIPSAQQRKKAFSTCSSHMIVVSVSYGSCIFMCVKTSAKEGMALSKGVAVLNTSVAPMLNPFIYTLRNQQVKQALREFTKKILSLNKQ

SEQ ID NO: 12629 - protein, 317 aa, Artificial Sequence
  Description of Artificial Sequence: Synthetic coding sequence
MQKSVMRKHTAITTFILLGLTEDPQLQVLLFMFLFITYMLSVTGKLTIIALTMLDPHLKTPMYFFLQNLSFLEISFTATCVPRFLYSISTGNKIITYNACVIQLFFADLFGVTEFFLLATMSYDRYVAICKPLHYMAIMSNKVCKTMVICCWMAALMIILPPLSLGFHLEFCDSNVINHFGCDALPILKIPCSDTSLIEQMVVASAVLTFIITLVCVVLSYTYIIRTILKFPSVQQKKKAFSTCSSHITVVSITYGSCIFIYIKPSAKEEVNINKGVSVLISSISPMLNSFIYTLRNEQVKQAFHDSLKKIAFRLKK

SEQ ID NO: 12630 - protein, 312 aa, Artificial Sequence
  Description of Artificial Sequence: Synthetic coding sequence
MRKHTAITTFILLGLTEDPQLQVLLFMFLFITYMLSVTGKLTIIALTMLDPHLKTPMYFFLQNLSFLEISFTATCVPRFLYSISTGNKIITYNACVIQLFFADLFGVTEFFLLATMSYDRYVAICKPLHYMAIMSNKVCKTMVICCWMAALMIILPPLSLGFHLEFCDSNVINHFGCDALPILKIPCSDTSLIEQMVVASAVLTFIITLVCVVLSYTYIIRTILKFPSVQQKKKAFSTCSSHITVVSITYGSCIFIYIKPSAKEEVNINKGVSVLISSISPMLNSFIYTLRNEQVKQAFHDSLKKIAFRLKK

SEQ ID NO: 12631 - protein, 312 aa, Artificial Sequence
  Description of Artificial Sequence: Synthetic coding sequence
MKNHTRQIEFILLGLTDNSQLQIVIFLFLLLNCVLSMIGNFTIIALILLDSQLKTPMYFFLRNFSFLEISFTTACIPRFLITIVTREKTISCNGCISQLFFYIFLGVTEFFLLAALSYDRYVAICKPLRYMSIMSNKVCYQLVFSSWVTGFLIIFTPLILGLNLDFCASNIIDHFICDISLILQLSCSDTHLLELIAFLLAVMTLIVTLFLVILSYSYIIKTILKFPSAQQKKKAFSTCSSHMIVVSITYGSCMFIYIKPSANERVALSKGVTVLNTSVAPLLNPFIYTLRNQQVKQAFKAVFRKIFSASDK

SEQ ID NO: 12632 - protein, 312 aa, Artificial Sequence
  Description of Artificial Sequence: Synthetic coding sequence
MRNHTTVANFILLGLTDDPQLQVIIFLLLFFTYMLSITGNLTIITLTLLDLHLKTPMYFFLRNFSFLEVSFTTVYIPKFLVSMATGDKTISYNDCAAQLFFTILLGATEFFLLAAMSYERYVAICKPLHYTTIMSSRVCSLLVFASWMAGFLIIFPPLLMGLQLDFCAANTVDHFFCDVSPILQLSCTDTDIIELMMLLSAILTLLVTLVLVILSYTNIIRTILKIPSSQQRKKAFSTCSSHMVVVSISYGSCIFMYVKPSAKERVSLNKGIALLSTSVAPMLNPFIYTLRNKQVKDVFKHTVKKIELFSMK

SEQ ID NO: 12633 - protein, 312 aa, Artificial Sequence
  Description of Artificial Sequence: Synthetic coding sequence
MRNSTAVTDFILLGLTSDPQWQVVLFIFLLVTYMLSVTGNLIIITLTLSDPHLQTPMYFFLRNFSFLEISFTSVCIPRFLVTVVTGNRTISYNGCVAQLFFFIFLGVTEFYLLAAMSYDRCMAICKPLHYTIIMSTRVCTLLVFSSWLAGFLIIFPPVMLLLQLDFCASNVIDHFICDSSPMLQLSCTNTHFLELMAFFLAVVTLMVTLTLVILSYTNIIRTILKIPSMSQRKKAFSTCSSHMIVVSISYSSCIFMYIKTSARERVTLSKGVAVLNTSVAPLLNPFIYTLRNKQVKQAFKSMVQKMIFSLNK

SEQ ID NO: 12634 - protein, 308 aa, Artificial Sequence
  Description of Artificial Sequence: Synthetic coding sequence
MDTGNKTLPQDFLLLGFPGSQTLQLSLFMLFLVMYILTVSGNVAILMLVSTSHQLHTPMYFFLSNLSFLEIWYTTAAVPKALAILLGRSQTISFTSCLLQMYFVFSLGCTEYFLLAAMAYDRCLAICYPLHYGAIMSSLLSAQLALGSWVCGFVAIAVPTALISGLSFCGPRAINHFFCDIAPWIALACTNTQAVELVAFVIAVVVILSSCLITFVSYVYIISTILRIPSASGRSKAFSTCSSHLTVVLIWYGSTVFLHVRTSIKDALDLIKAVHVLNTVVTPVLNPFIYTLRNKEVRETLLKKWKGK

SEQ ID NO: 12635 - protein, 347 aa, Artificial Sequence
  Description of Artificial Sequence: Synthetic coding sequence
MGNWTAAVTEFVLLGFSLSREVELLLLVLLLPTFLLTLLGNLLIISTVLSCSRLHTPMYFFLCNLSILDILFTSVISPKVLANLGSRDKTISFAGCITQCYFYFFLGTVEFLLLTVMSYDRYATICCPLRYTTIMRPSVCIGTVVFSWVGGFLSVLFPTILISQLPFCGSNIINHFFCDSGPLLALACADTTAIELMDFMLSSMVILCCIVLVAYSYTYIILTIVRIPSASGRKKAFNTCASHLTIVIIPSGITVFIYVTPSQKEYLEINKIPLVLSSVVTPFLNPFIYTLRNDTVQGVLRDVWVRVRGVFEKRMRAVLRSRLSSNKDHQGRACSSPPCVYSVKLQC

SEQ ID NO: 12636 - protein, 324 aa, Artificial Sequence
  Description of Artificial Sequence: Synthetic coding sequence
MESPNRTTIQEFIFSAFPYSWVKSVVCFVPLLFIYAFIVVGNLVIITVVQLNTHLHTPMYTFISALSFLEIWYTTATIPKMLSSLLSERSISFNGCLLQMYFFHSTGICEVCLLTVMAFDHYLAICSPLHYPSIMTPKLCTQLTLSCCVCGFITPLPEIAWISTLPFCGSNHLEHIFCDFLPVLRLACTDTRAIVMIQVVDVIHAVEIITAVMLIFMSYDGIVAVILRIHSAGGRRTAFSTCVSHFIVFSLFFGSVTLMYLRFSATYSLFWDIAIALAFAVLSPFFNPIIYSLRNKEIKEAIKKHIGQAKIFFSVRPGTSSKIF

SEQ ID NO: 12637 - protein, 315 aa, Artificial Sequence
  Description of Artificial Sequence: Synthetic coding sequence
MESGNQSTVTEFIFTGFPQLQDGSLLYFFPLLFIYTFIIIDNLLIFSAVRLDTHLHNPMYNFISIFSFLEIWYTTATIPKMLSNLISEKKAISMTGCILQMYFFHSLENSEGILLTTMAIDRYVAICNPLRYQMIMTPRLCAQLSAGSCLFGFLILLPEIVMISTLPFCGPNQIHQIFCDLVPVLSLACTDTSMILIEDVIHAVTIIITFLIIALSYVRIVTVILRIPSSEGRQKAFSTCAGHLMVFPIFFGSVSLMYLRFSDTYPPVLDTAIALMFTVLAPFFNPIIYSLRNKDMNNAIKKLFCLQKVLNKPGG

SEQ ID NO: 12638 - protein, 331 aa, Artificial Sequence
  Description of Artificial Sequence: Synthetic coding sequence
MCWTMPSPFTGSSTRNMESGNQSTVTEFIFTGFPQLQDGSLLYFFPLLFIYTFIIIDNLLIFSAVRLDTHLHNPMYNFISIFSFLEIWYTTATIPKMLSNLISEKKAISMTGCILQMYFFHSLENSEGILLTTMAIDRYVAICNPLRYQMIMTPRLCAQLSAGSCLFGFLILLPEIVMISTLPFCGPNQIHQIFCDLVPVLSLACTDTSMILIEDVIHAVTIIITFLIIALSYVRIVTVILRIPSSEGRQKAFSTCAGHLMVFPIFFGSVSLMYLRFSDTYPPVLDTAIALMFTVLAPFFNPIIYSLRNKDMNNAIKKLFCLQKVLNKPGG

SEQ ID NO: 12639 - protein, 343 aa, Artificial Sequence
  Description of Artificial Sequence: Synthetic coding sequence
MKQYSVGNQHSNYRSLLFPFLCSQMTQLTASGNQTMVTEFLFSMFPHAHRGGLLFFIPLLLIYGFILTGNLIMFIVIQVGMALHTPLYFFISVLSFLEICYTTTTIPKMLSCLISEQKSISVAGCLLQMYFFHSLGITESCVLTAMAIDRYIAICNPLRYPTIMIPKLCIQLTVGSCFCGFLLVLPEIAWISTLPFCGSNQIHQIFCDFTPVLSLACTDTFLVVIVDAIHAAEIVASFLVIALSYIRIIIVILGMHSAEGHHKAFSTCAAHLAVFLLFFGSVAVMYLRFSATYSVFWDTAIAVTFVILAPFFNPIIYSLKNKDMKEAIGRLFHYQKRAGWAGK

SEQ ID NO: 12640 - protein, 313 aa, Artificial Sequence
  Description of Artificial Sequence: Synthetic coding sequence
MGNWSTVTEITLIAFPALLEIRISLFVVLVVTYTLTATGNITIISLIWIDHRLQTPMYFFLSNLSFLDILYTTVITPKLLACLLGEEKTISFAGCMIQTYFYFFLGTVEFILLAVMSFDRYMAICDPLHYTVIMNSRACLLLVLGCWVGAFLSVLFPTIVVTRLPYCRKEINHFFCDIAPLLQVACINTHLIEKINFLLSALVILSSLAFTTGSYVYIISTILRIPSTQGRQKAFSTCASHITVVSIAHGSNIFVYVRPNQNSSLDYDKVAAVLITVVTPLLNPFIYSLRNEKVQEVLRETVNRIMTLIQRKT

SEQ ID NO: 12641 - protein, 312 aa, Artificial Sequence
  Description of Artificial Sequence: Synthetic coding sequence
MDTGNWSQVAEFIILGFPHLQGVQIYLFLLLLLIYLMTVLGNLLIFLVVCLDSRLHTPMYHFVSILSFSELGYTAATIPKMLANLLSEKKTISFSGCLLQIYFFHSLGATECYLLTAMAYDRYLAICRPLHYPTLMTPTLCAEIAIGCWLGGLAGPVVEISLISRLPFCGPNRIQHVFCDFPPVLSLACTDTSINVLVDFVINSCKILATFLLILCSYVQIICTVLRIPSAAGKRKAISTCASHFTVVLIFYGSILSMYVQLKKSYSLDYDQALAVVYSVLTPFLNPFIYSLRNKEIKEAVRRQLKRIGILA

SEQ ID NO: 12642 - protein, 317 aa, Artificial Sequence
  Description of Artificial Sequence: Synthetic coding sequence
MDQYNHSSLAEFVFLGFASVGYVRGWLFVLLLLAYLFTICGNMLIFSVIRLDAALHTPMYHFVSVLSFLELWYTATTIPKMLSNILSEKKTISFAGCLLQTYFFHSLGASECYLLTAMAYDRYLAICRPLHYPIIMTTTLCAKMAAACWTCGFLCPISEVILASQLPFCAYNEIQHIFCDFPPLLSLACKDTSANILVDFAINAFIILITFFFIMISYARIIGAVLKIKTASGRKKAFSTCASHLAVVLIFFGSIIFMYVRLKKSYSLTLDRTLAIVYSVLTPMVNPIIYSLRNKEIIKAIKRTIFQKGDKASLAHL

SEQ ID NO: 12643 - protein, 317 aa, Artificial Sequence
  Description of Artificial Sequence: Synthetic coding sequence
MRNLSGGHVEEFVLVGFPTTPPLQLLLFVLFFAIYLLTLLENALIVFTIWLAPSLHRPMYFFLGHLSFLELWYINVTIPRLLAAFLTQDGRVSYVGCMTQLYFFIALACTECVLLAVMAYDRYLAICGPLLYPSLMPSSLATRLAAASWGSGFFSSMMKLLFISQLSYCGPNIINHFFCDISPLLNLTCSDKEQAELVDFLLALVMILLPLLAVVSSYTAIIAAILRIPTSRGRHKAFSTCAAHLAVVVIYYSSTLFTYARPRAMYTFNHNKIISVLYTIIVPFFNPAIYCLRNKEVKEAFRKTVMGRCHYPRDVQD

SEQ ID NO: 12644 - protein, 317 aa, Artificial Sequence
  Description of Artificial Sequence: Synthetic coding sequence
MQPYTKNWTQVTEFVMMGFAGIHEAHLLFFILFLTMYLFTLVENLAIILVVGLDHRLRRPMYFFLTHLSCLEIWYTSVTVPKMLAGFIGVDGGKNISYADCLSQLFIFTFLGATECFLLAAMAYDRYVAICMPLHYGAFVSWGTCIRLAAACWLVGFLTPILPIYLLSQLTFYGPNVIDHFSCDASPLLALSCSDVTWKETVDFLVSLAVLLASSMVIAVSYGNIVWTLLHIRSAAERWKAFSTCAAHLTVVSLFYGTLFFMYVQTKVTSSINFNKVVSVFYSVVTPMLNPLIYSLRNKEVKGALGRVFSLNFWKGQ

SEQ ID NO: 12645 - protein, 331 aa, Artificial Sequence
  Description of Artificial Sequence: Synthetic coding sequence
MSPDGNHSSDPTEFVLAGLPNLNSARVELFSVFLLVYLLNLTGNVLIVGVVRADTRLQTPMYFFLGNLSCLEILLTSVIIPKMLSNFLSRQHTISFAACITQFYFYFFLGASEFLLLAVMSADRYLAICHPLRYPLLMSGAVCFRVALACWVGGLVPVLGPTVAVALLPFCKQGAVVQHFFCDSGPLLRLACTNTKKLEETDFVLASLVIVSSLLITAVSYGLIVLAVLSIPSASGRQKAFSTCTSHLIVVTLFYGSAIFLYVRPSQSGSVDTNWAVTVITTFVTPLLNPFIYALRNEQVKEALKDMFRKVVAGVLGNLLLDKCLSEKAVK

SEQ ID NO: 12646 - protein, 323 aa, Artificial Sequence
  Description of Artificial Sequence: Synthetic coding sequence
MNPENWTQVTSFVLLGFPSSHLIQFLVFLGLMVTYIVTATGKLLIIVLSWIDQRLHIQMYFFLRNFSFLELLLVTVVVPKMLVVILTGDHTISFVSCIIQSYLYFFLGTTDFFLLAVMSLDRYLAICRPLRYETLMNGHVCSQLVLASWLAGFLWVLCPTVLMASLPFCGPNGIDHFFRDSWPLLRLSCGDTHLLKLVAFMLSTLVLLGSLALTSVSYACILATVLRAPTAAERRKAFSTCASHLTVVVIIYGSSIFLYIRMSEAQSKLLNKGASVLSCIITPLLNPFIFTLRNDKVQQALREALGWPRLTAVMKLRVTSQRK

SEQ ID NO: 12647 - protein, 313 aa, Artificial Sequence
  Description of Artificial Sequence: Synthetic coding sequence
MANLSQPSEFVLLGFSSFGELQALLYGPFLMLYLLAFMGNTIIIVMVIADTHLHTPMYFFLGNFSLLEILVTMTAVPRMLSDLLVPHKVITFTGCMVQFYFHFSLGSTSFLILTDMALDRFVAICHPLRYGTLMSRAMCVQLAGAAWAAPFLAMVPTVLSRAHLDYCHGDVINHFFCDNEPLLQLSCSDTRLLEFWDFLMALTFVLSSFLVTLISYGYIVTTVLRIPSASSCQKAFSTCGSHLTLVFIGYSSTIFLYVRPGKAHSVQVRKVVALVTSVLTPFLNPFILTFCNQTVKTVLQGQMQRLKGLCKAQ

SEQ ID NO: 12648 - protein, 312 aa, Artificial Sequence
  Description of Artificial Sequence: Synthetic coding sequence
MRNGTVITEFILLGFPVIQGLQTPLFIAIFLTYILTLAGNGLIIATVWAEPRLQIPMYFFLCNLSFLEIWYTTTVIPKLLGTFVVARTVICMSCCLLQAFFHFFVGTTEFLILTIMSFDRYLTICNPLHHPTIMTSKLCLQLALSSWVVGFTIVFCQTMLLIQLPFCGNNVISHFYCDVGPSLKAACIDTSILELLGVIATILVIPGSLLFNMISYIYILSAILRIPSATGHQKTFSTCASHLTVVSLLYGAVLFMYLRPTAHSSFKINKVVSVLNTILTPLLNPFIYTIRNKEVKGALRKAMTCPKTGHAK

SEQ ID NO: 12649 - protein, 325 aa, Artificial Sequence
  Description of Artificial Sequence: Synthetic coding sequence
MTTIILEVDNHTVTTRFILLGFPTRPAFQLLFFSIFLATYLLTLLENLLIILAIHSDGQLHKPMYFFLSHLSFLEMWYVTVISPKMLVDFLSHDKSISFNGCMTQLYFFVTFVCTEYILLAIMAFDRYVAICNPLRYPVIMTNQLCGTLAGGCWFCGLMTAMIKMVFIAQLHYCGMPQINHYFCDISPLLNVSCEDASQAEMVDFFLALMVIAIPLCVVVASYAAILATILRIPSAQGRQKAFSTCASHLTVVILFYSMTLFTYARPKLMYAYNSNKVVSVLYTVIVPLLNPIIYCLRNHEVKAALRKTIHCRGSGPQGNGAFSS

SEQ ID NO: 12650 - protein, 309 aa, Artificial Sequence
  Description of Artificial Sequence: Synthetic coding sequence
MKSWNNTIILEFLLLGISEEPELQAFLFGLFLSMYLVTVLGNLLIILATISDSHLHTPMYFFLSNLSFVDICFVSTTVPKMLVNIQTHNKVITYAGCITQMCFFLLFVGLDNFLLTVMAYDRFVAICHPLHYMVIMNPQLCGLLVLASWIMSVLNSMLQSLMVLPLPFCTHMEIPHFFCEINQVVHLACSDTFLNDIVMYFAVALLGGGPLTGILYSYSKIVSSIRAISSAQGKYKAFSTCASHLSVVSLFYGTCLGVYLSSAATHNSHTGAAASVMYTVVTPMLNPFIYSLRNKHIKGAMKTFFRGKQ

SEQ ID NO: 12651 - protein, 309 aa, Artificial Sequence
  Description of Artificial Sequence: Synthetic coding sequence
MEPENDTGISEFVLLGLSEEPELQPFLFGLFLSMYLVTVLGNLLIILATISDSHLHTPMYFFLSNLSFADICFISTTIPKMLINIQTQSRVITYAGCITQMCFFVLFGGLDSLLLAVMAYDRFVAICHPLHYTVIMNPRLCGLLVLASWMIAALNSLSQSLMVLWLSFCTDLEIPHFFCELNQVIHLACSDTFLNDMGMYFAAGLLAGGPLVGILCSYSKIVSSIRAISSAQGKYKAFSTCASHLSVVSLFCCTGLGVYLTSAATHNSHTSATASVMYTVATPMLNPFIYSLRNKDIKRALKMSFRGKQ

SEQ ID NO: 12652 - protein, 309 aa, Artificial Sequence
  Description of Artificial Sequence: Synthetic coding sequence
VKAGNETQISEFLLLGFSEKQELQPFLFGLFLSMYLVTVLGNLLIILAAISDSCLHTPMYFFLSNLSFVDICFASTMVPKMLVNIQTQSKVITYAGCITQMCFFVLFIVLDSLLLTVMAYDQFVAICHPLHYTVIMSPQLCGLLVLVSWIMSVLNSMLQSLVTLQLSFCTDLEIPHFFCELNEMIHLACSDTFVNNMVMHFAAVLLDGGPLVGILYSYCRIVSSIRAISSTQGKYKALSTCASHLSVVSIFYGTGLGVYLSSTMTQNLHSTAVASVMYTVVTPMLNPFIYSLRNKDIKGALTQFFRGKQ

SEQ ID NO: 12653 - protein, 319 aa, Artificial Sequence; identical to SEQ ID NO: 12179
  Description of Artificial Sequence: Synthetic coding sequence

SEQ ID NO: 12654 - protein, 312 aa, Artificial Sequence
  Description of Artificial Sequence: Synthetic coding sequence
MEAGNQTGFLEFILLGLSEDPELQPFIFGLFLSMYLVTVLGNLLIILAISSDSHLHTPMYFFLSNLSWVDICFSTCIVPKMLVNIQTENKAISYMDCLTQVYFSMFFPILDTLLLTVMAYDRFVAVCHPLHYMIIMNPHLCGLLVFVTWLIGVMTSLLHISLMMHLIFCKDFEIPHFFCELTYILQLACSDTFLNSTLIYFMTGVLGVFPLLGIIFSYSRIASSIRKMSSSGGKQKALSTCGSHLSVVSLFYGTGIGVHFTSAVTHSSQKISVASVMYTVVTPMLNPFIYSLRNKDVKGALGSLLSRAASCL

SEQ ID NO: 12655 - protein, 339 aa, Artificial Sequence
  Description of Artificial Sequence: Synthetic coding sequence
MSYFPILFFFFLKRCPSYTEPQNLTGVSEFLLLGLSEDPELQPVLAGLFLSMYLVTVLGNLLIILAVSSDSHLHTPMYFFLSNLSLADIGFTSTTVPKMIVDMQTHSRVISYEGCLTQMSFFVLFACMDDMLLSVMAYDRFVAICHPLHYRIIMNPRLCGFLILLSFFISLLDSQLHNLIMLQLTCFKDVDISNFFCDPSQLLHLRCSDTFINEMVIYFMGAIFGCLPISGILFSYYKIVSPILRVPTSDGKYKAFSTCGSHLAVVCLFYGTGLVGYLSSAVLPSPRKSMVASVMYTVVTPMLNPFIYSLRNKDIQSALCRLHGRIIKSHHLHPFCYMG

SEQ ID NO: 12656 - protein, 333 aa, Artificial Sequence
  Description of Artificial Sequence: Synthetic coding sequence
MGPRNQTAVSEFLLMKVTEDPELKLIPFSLFLSMYLVTILGNLLILLAVISDSHLHTPMYFLLFNLSFTDICLTTTTVPKILVNIQAQNQSITYTGCLTQICLVLVFAGLESCFLAVMAYDRYVAICHPLRYTVLMNVHFWGLLILLSMFMSTMDALVQSLMVLQLSFCKNVEIPLFFCEVVQVIKLACSDTLINNILIYFASSVFGAIPLSGIIFSYSQIVTSVLRMPSARGKYKAFSTCGCHLSVFSLFYGTAFGVYISSAVAESSRITAVASVMYTVVPQMMNPFIYSLRNKEMKKALRKLIGWSTVARSRLTANSASRVHAILLPRPPE

SEQ ID NO: 12657 - protein, 311 aa, Artificial Sequence
  Description of Artificial Sequence: Synthetic coding sequence
MGPRNQTAVSEFLLMKVTEDPELKLIPFSLFLSMYLVTILGNLLILLAVISDSHLHTPMYFLLFNLSFTDICLTTTTVPKILVNIQAQNQSITYTGCLTQICLVLVFAGLESCFLAVMAYDRYVAICHPLRYTVLMNVHFWGLLILLSMFMSTMDALVQSLMVLQLSFCKNVEIPLFFCEVVQVIKLACSDTLINNILIYFASSVFGAIPLSGIIFSYSQIVTSVLRMPSARGKYKAFSTCGCHLSVFSLFYGTAFGVYISSAVAESSRITAVASVMYTVVPQMMNPFIYSLRNKEMKKALRKLIGRLFPF

SEQ ID NO: 12658 - protein, 345 aa, Artificial Sequence
  Description of Artificial Sequence: Synthetic coding sequence
MPMQLLLTDFIIFSIRFIINSMEARNQTAISKFLLLGLIEDPELQPVLFSLFLSMYLVTILGNLLILLAVISDSHLHTPMYFFLSNLSFLDICLSTTTIPKMLVNIQAQNRSITYSGCLTQICFVLFFAGLENCLLAAMAYDRYVAICHPLRYTVIMNPRLCGLLILLSLLTSVVNALLLSLMVLRLSFCTDLEIPLFFCELAQVIQLTCSDTLINNILIYFAACIFGGVPLSGIILSYTQITSCVLRMPSASGKHKAVSTCGSHLSIVLLFYGAGLGVYISSVVTDSPRKTAVASVMYSVFPQMVNPFIYSLRNKDMKGTLRKFIGRIPSLLWCAICFGFRFLE

SEQ ID NO: 12659 - protein, 312 aa, Artificial Sequence
  Description of Artificial Sequence: Synthetic coding sequence
MKAGNFSDTPEFFLLGLSGDPELQPILFMLFLSMYLATMLGNLLIILAVNSDSHLHTPMYFLLSILSLVDICFTSTTMPKMLVNIQAQAQSINYTGCLTQICFVLVFVGLENGILVMMAYDRFVAICHPLRYNVIMNPKLCGLLLLLSFIVSVLDALLHTLMVLQLTFCIDLEIPHFFCELAHILKLACSDVLINNILVYLVTSLLGVVPLSGIIFSYTRIVSSVMKIPSAGGKYKAFSICGSHLIVVSLFYGTGFGVYLSSGATHSSRKGAIASVMYTVVTPMLNPLIYSLRNKDMLKALRKLISRIPSFH

SEQ ID NO: 12660 - protein, 326 aa, Artificial Sequence
  Description of Artificial Sequence: Synthetic coding sequence
MGFLSPMHPCRPPTQRRMAAGNHSTVTEFILKGLTKRADLQLPLFLLFLGIYLVTIVGNLGMITLICLNSQLHTPMYYFLSNLSLMDLCYSSVITPKMLVNFVSEKNIISYAGCMSQLYFFLVFVIAECYMLTVMAYDRYVAICHPLLYNIIMSHHTCLLLVAVVYAIGLIGSTIETGLMLKLPYCEHLISHYFCDILPLMKLSCSSTYDVEMTVFFSAGFNIIVTSLTVLVSYTFILSSILGISTTEGRSKAFSTCSSHLAAVGMFYGSTAFMYLKPSTISSLTQENVASVFYTTVIPMLNPLIYSLRNKEVKAAVQKTLRGKLF

SEQ ID NO: 12661 - protein, 310 aa, Artificial Sequence
  Description of Artificial Sequence: Synthetic coding sequence
MAAKNSSVTEFILEGLTHQPGLRIPLFFLFLGFYTVTVVGNLGLITLIGLNSHLHTPMYFFLFNLSLIDFCFSTTITPKMLMSFVSRKNIISFTGCMTQLFFFCFFVVSESFILSAMAYDRYVAICNPLLYTVTMSCQVCLLLLLGAYGMGFAGAMAHTGSIMNLTFCADNLVNHFMCDILPLLELSCNSSYMNELVVFIVVAVDVGMPIVTVFISYALILSSILHNSSTEGRSKAFSTCSSHIIVVSLFFGSGAFMYLKPLSILPLEQGKVSSLFYTIIVPVLNPLIYSLRNKDVKVALRRTLGRKIFS

SEQ ID NO: 12662 - protein, 313 aa, Artificial Sequence
  Description of Artificial Sequence: Synthetic coding sequence
MLARNNSLVTEFILAGLTDHPEFRQPLFFLFLVIYIVTMVGNLGLITLFGLNSHLHTPMYYFLFNLSFIDLCYSSVFTPKMLMNFVSKKNIISNVGCMTRLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGTNITVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 12663 - protein, 313 aa, Artificial Sequence
  Description of Artificial Sequence: Synthetic coding sequence
MLARNNSLVTEFILAGLTDHPEFQQPLFFLFLVVYIVTMVGNLGLIILFGLNSHLHTPMYYFLFNLSFIDLCYSSVFTPKMLMNFVSKKNIISYVGCMTQLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGINIMVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 12664 - protein, 309 aa, Artificial Sequence
  Description of Artificial Sequence: Synthetic coding sequence
MTLRNSSSVTEFILVGLSEQPELQLPLFLLFLGIYVFTVVGNLGLITLIGINPSLHTPMYFFLFNLSFIDLCYSCVFTPKMLNDFVSESIISYVGCMTQLFFFCFFVNSECYVLVSMAYDRYVAICNPLLYMVTMSPRVCFLLMFGSYVVGFAGAMAHTGSMLRLTFCDSNVIDHYLCDVLPLLQLSCTSTHVSELVFFIVVGVITMLSSISIVISYALILSNILCIPSAEGRSKAFSTWGSHIIAVALFFGSGTFTYLTTSFPGSMNHGRFASVFYTNVVPMLNPSIYSLRNKDDKLALGKTLKRVLF

SEQ ID NO: 12665 - protein, 311 aa, Artificial Sequence
  Description of Artificial Sequence: Synthetic coding sequence
MAAENSSFVTQFILAGLTDQPGVQIPLFFLFLGFYVVTVVGNLGLITLIRLNSHLHTPMYFFLYNLSFIDFCYSSVITPKMLMSFVLKKNSISYAGCMTQLFFFLFFVVSESFILSAMAYDRYVAICNPLLYMVTMSPQVCFLLLLGVYGMGFAGAMAHTACMMGVTFCANNLVNHYMCDILPLLECACTSTYVNELVVFVVVGIDIGVPTVTIFISYALILSSIFHIDSTEGRSKAFSTCSSHIIAVSLFFGSGAFMYLKPFSLLAMNQGKVSSLFYTTVVPMLNPLIYSLRNKDVKVALKKILNKNAFS

SEQ ID NO: 12666 - protein, 308 aa, Artificial Sequence
  Description of Artificial Sequence: Synthetic coding sequence
MTMENYSMAAQFVLDGLTQQAELQLPLFLLFLGIYVVTVVGNLGMILLIAVSPLLHTPMYYFLSSLSFVDFCYSSVITPKMLVNFLGKKNTILYSECMVQLFFFVVFVVAEGYLLTAMAYDRYVAICSPLLYNAIMSSWVCSLLVLAAFFLGFLSALTHTSAMMKLSFCKSHIINHYFCDVLPLLNLSCSNTHLNELLLFIIAGFNTLVPTLAVAVSYAFILYSILHIRSSEGRSKAFGTCSSHLMAVVIFFGSITFMYFKPPSSNSLDQEKVSSVFYTTVIPMLNPLIYSLRNKDVKKALRKVLVGK

SEQ ID NO: 12667 - protein, 311 aa, Artificial Sequence
  Description of Artificial Sequence: Synthetic coding sequence
MATSNHSSGAEFILAGLTQRPELQLPLFLLFLGIYVVTVVGNLGMIFLIALSSQLYPPVYYFLSHLSFIDLCYSSVITPKMLVNFVPEENIISFLECITQLYFFLIFVIAEGYLLTAMEYDRYVAICRPLLYNIVMSHRVCSIMMAVVYSLGFLWATVHTTRMSVLSFCRSHTVSHYFCDILPLLTLSCSSTHINEILLFIIGGVNTLATTLAVLISYAFIFSSILGIHSTEGQSKAFGTCSSHLLAVGIFFGSITFMYFKPPSSTTMEKEKVSSVFYITIIPMLNPLIYSLRNKDVKNALKKMTRGRQSS

SEQ ID NO: 12668 - protein, 314 aa, Artificial Sequence
  Description of Artificial Sequence: Synthetic coding sequence
MGVKNHSTVTEFLLSGLTEQAELQLPLFCLFLGIYTVTVVGNLSMISIIRLNRQLHTPMYYFLSSLSFLDFCYSSVITPKMLSGFLCRDRSISYSGCMIQLFFFCVCVISECYMLAAMACDRYVAICSPLLYRVIMSPRVCSLLVAAVFSVGFTDAVIHGGCILRLSFCGSNIIKHYFCDIVPLIKLSCSSTYIDELLIFVIGGFNMVATSLTIIISYAFILTSILRIHSKKGRCKAFSTCSSHLTAVLMFYGSLMSMYLKPASSSSLTQEKVSSVFYTTVILMLNPLIYSLRNNEVRNALMKLLRRKISLSPG

SEQ ID NO: 12669 - protein, 311 aa, Artificial Sequence
  Description of Artificial Sequence: Synthetic coding sequence
MGRRNNTNVPDFILTGLSDSEEVQMALFILFLLIYLITMLGNVGMILIIRLDLQLHTPMYFFLTHLSFIDLSYSTVITPKTLANLLTSNYISFMGCFAQMFFFVFLGAAECFLLSSMAYDRYVAICSPLRYPVIMSKRLCCALVTGPYVISFINSFVNVVWMSRLHFCDSNVVRHFFCDTSPILALSCMDTYDIEIMIHILAGSTLMVSLITISASYVSILSTILKINSTSGKQKALSTCASHLLGVTIFYGTMIFTYLKPRKSYSLGRDQVASVFYTIVIPMLNPLIYSLRNKEVKNALIRVMQRRQDSR

SEQ ID NO: 12670 - protein, 309 aa, Artificial Sequence
  Description of Artificial Sequence: Synthetic coding sequence
NNTNVPDFILTGLSDSEEVQMALFILFLLIYLITMLGNVGMILIIRLDLQLHTPMYFFLTHLSFIDLSYSTVITPKTLANLLTSNYISFMGCFAQMFFFVFLGAAECFLLSSMAYDRYVAICSPLRYPVIMSKRLCCALVTGPYVISFINSFVNVVWMSRLHFCDSNVVRHFFCDTSPILALSCMDTYDIEIMIHILAGSTLMVSLITISASYVSILSTILKINSTSGKQKALSTCASHLLGVTIFYGTMIFTYLKPRKSYSLGRDQVASVFYTIVIPMLNPLIYSLRNKEVKNALIRVMQRIWYVLGL

SEQ ID NO: 12671 - protein, 312 aa, Artificial Sequence
  Description of Artificial Sequence: Synthetic coding sequence
MMGRRNNTNVADFILMGLTLSEEIQMALFMLFLLIYLITMLGNVGMILIIRLDLQLHTPMYFFLTHLSFIDLSYSTVVTPKTLANLLTSNYISFTGCFAQMFFFAFLGTAECYLLSSMAHDRYAAICSPLHYTVIMSKRLCLALITGPYVIGFIDSFVNVVSMSRLHFYDSNVIHHFFCDTSPILALSCTDTYNTEILIFIIVGSTLMVSLFTISASYVFILFTILKINSTSGKQKAFSTCVSHLLGVTIFYSTLIFTYLKPRKSYSLGRDQVASVFYTIVIPVLNPLIYSLRNKEVKNAVIRVMQRRQDSR

SEQ ID NO: 12672 - protein, 312 aa, Artificial Sequence
  Description of Artificial Sequence: Synthetic coding sequence
MMGRRNDTNVADFILTGLSDSEEVQMALFMLFLLIYLITMLGNVGMLLIIRLDLQLHTPMYFFLTHLSFIDLSYSTVVTPKTLANLLTSNYISFTGCFAQMFCFVFLGTAECYLLSSMAYDRYAAICSPLHYTVIMPKRLCLALITGPYVIGFMDSFVNVVSMSRLHFCDSNIIHHFFCDTSPILALSCTDTDNTEMLIFIIAGSTLMVSLITISASYVSILSTILKINSTSGKQKAFSTCVSHLLGVTIFYGTMIFTYLKPRKSYSLGRDQVAPVFYTIVIPMLNPLIYSLRNREVKNALIRVMQRRQDSR

SEQ ID NO: 12673 - protein, 310 aa, Artificial Sequence
  Description of Artificial Sequence: Synthetic coding sequence
MAGNNFTEVTVFILSGFANHPELQVSLFLMFLFIYLFTVLGNLGLITLIRMDSQLHTPMYFFLSNLAFIDIFYSSTVTPKALVNFQSNRRSISFVGCFVQMYFFVGLVCCECFLLGSMAYNRYIAICNPLLYSVVMSQKVSNWLGVMPYVIGFTSSLISVWVISSLAFCDSSINHFFCDTTALLALSCVDTFGTEMVSFVLAGFTLLSSLLIITVTYIIIISAILRIQSAAGRQKAFSTCASHLMAVTIFYGSLIFTYLQPDNTSSLTQAQVASVFYTIVIPMLNPLIYSLRNKDVKNALLRVIHRKLFP

SEQ ID NO: 12674 - protein, 316 aa, Artificial Sequence
  Description of Artificial Sequence: Synthetic coding sequence
MAPENFTRVTEFILTGVSSCPELQIPLFLVFLVLYGLTMAGNLGIITLTSVDSRLQTPMYFFLQHLALINLGNSTVIAPKMLINFLVKKKTTSFYECATQLGGFLFFIVSEVIMLALMAYDRYVAICNPLLYMVVVSRRLCLLLVSLTYLYGFSTAIVVSSYVFSVSYCSSNIINHFYCDNVPLLALSCSDTYLPETVVFISAATNVVGSLIIVLVSYFNIVLSILKICSSEGRKKAFSTCASHMMAVTIFYGTLLFMYVQPRSNHSLDTDDKMASVFYTLVIPMLNPLIYSLRNKDVKTALQRFMTNLCYSFKTM

SEQ ID NO: 12675 - protein, 315 aa, Artificial Sequence
  Description of Artificial Sequence: Synthetic coding sequence
MAPENFTRVTEFILTGVSSCPELQIPLFLVFLVLYVLTMAGNLGIITLTSVDSRLQNPMYFFLRHLAIINLGNSTVIAPKMLMNFLVKKKTTSFYECATQLGGFLFFIVSEVMMLAVMAYDRYVAICNPLLYMVVVSRRLCLLLVSLTYLYGFSTAIVVSPCIFSVSYCSSNIINHFYCDIAPLLALSCSDTYIPETIVFISAATNLVFSMITVLVSYFNIVLSILRIRSPEGRKKAFSTCASHMIAVTVFYGTMLFMYLQPQTNHSLDTDKMASVFYTLVIPMLNPLIYSLRNNDVNVALKKFMENPCYSFKSM

SEQ ID NO: 12676 - protein, 319 aa, Artificial Sequence
  Description of Artificial Sequence: Synthetic coding sequence
MNHVVKHNHTAVTKVTEFILMGITDNPGLQAPLFGLFLIIYLVTVIGNLGMVILTYLDSKLHTPMYFFLRHLSITDLGYSTVIAPKMLVNFIVHKNTISYNWYATQLAFFEIFIISELFILSAMAYDRYVAICKPLLYVIIMAEKVLWVLVIVPYLYSTFVSLFLTIKLFKLSFCGSNIISYFYCDCIPLMSILCSDTNELELIILIFSGCNLLFSLSIVLISYMFILVAILRMNSRKGRYKAFSTCSSHLTVVIMFYGTLLFIYLQPKSSHTLAIDKMASVFYTLLIPMLNPLIYSLRNKEVKDALKRTLTNRFKIPI

SEQ ID NO: 12677 - protein, 312 aa, Artificial Sequence
  Description of Artificial Sequence: Synthetic coding sequence
MEQHNLTTVNEFILTGITDIAELQAPLFALFLMIYVISVMGNLGMIVLTKLDSRLQTPMYFFLRHLAFMDLGYSTTVGPKMLVNFVVDKNIISYYFCATQLAFFLVFIGSELFILSAMSYDLYVAICNPLLYTVIMSRRVCQVLVAIPYLYCTFISLLVTIKIFTLSFCGYNVISHFYCDSLPLLPLLCSNTHEIELIILIFAAIDLISSLLIVLLSYLLILVAILRMNSAGRQKAFSTCGAHLTVVIVFYGTLLFMYVQPKSSHSFDTDKVASIFYTLVIPMLNPLIYSLRNKDVKYALRRTWNNLCNIFV

SEQ ID NO: 12678 - protein, 307 aa, Artificial Sequence
  Description of Artificial Sequence: Synthetic coding sequence
MGQHNLTVLTEFILMELTRRPELQIPLFGVFLVIYLITVVGNLTMIILTKLDSHLHTPMYFSIRHLAFVDLGNSTVICPKVLANFVVDRNTISYYACAAQLAFFLMFIISEFFILSAMAYDRYVAICNPLLYYVIMSQRLCHVLVGIQYLYSTFQALMFTIKIFTLTFCGSNVISHFYCDDVPLLPMLCSNAQEIELLSILFSVFNLISSFLIVLVSYMLILLAICQMHSAEGRKKAFSTCGSHLTVVVVFYGSLLFMYMQPNSTHFFDTDKMASVFYTLVIPMLNPLIYSLRNEEVKNAFYKLFEN

SEQ ID NO: 12679 - protein, 359 aa, Artificial Sequence
  Description of Artificial Sequence: Synthetic coding sequence
MALGNHSTITEFLLLGLSADPNIRALLFVLFLGIYLLTIMENLMLLLMIRADSCLHKPMYFFLSHLSFVDLCFSSVIVPKMLENLLSQRKTISVEGCLAQVFFVFVTAGTEACLLSGMAYDRHAAICRPLLYGQIMGKQLYMHLVWGSWGLGFLDALINVLLAVNMVFCEAKIIHHYSYEMPSLLPLSCSDISRSLIALLCSTLLHGLGNFLLVFLSYTRIISTILSISSTSGRSKAFSTCSAHLTAVTLYYGSGLLRHLMPNSGSPIELIFSVQYTVVTPMLNSLIYSLKNKEVKGERSLRDSSHLPQLHKGQARWKRPAFTEGRREPGHPELSIPVTPQPQGACACSALRAAPTALP

SEQ ID NO: 12680 - protein, 309 aa, Artificial Sequence
  Description of Artificial Sequence: Synthetic coding sequence
MAHINCTQATEFILVGLTDHQELKMPLFVLFLSIYLFTVVGNLGLILLIRADTSLNTPMYFFLSNLAFVDFCYSSVITPKMLGNFLYKQNVISFDACATQLGCFLTFMISESLLLASMAYDRYVAICNPLLYMVVMTPGICIQLVAVPYSYSFLMALFHTILTFRLSYCHSNIVNHFYCDDMPLLRLTCSDTRFKQLWIFACAGIMFISSLLIVFVSYMFIISAILRMHSAEGRQKAFSTCGSHMLAVTIFYGTLIFMYLQPSSSHALDTDKMASVFYTVIIPMLNPLIYSLQNKEVKEALKKIIINKN

SEQ ID NO: 12681 - protein, 310 aa, Artificial Sequence
  Description of Artificial Sequence: Synthetic coding sequence
MMDNHSSATEFHLLGFPGSQGLHHILFAIFFFFYLVTLMGNTVIIVIVCVDKRLQSPMYFFLSHLSTLEILVTTIIVPMMLWGLLFLGCRQYLSLHVSLNFSCGTMEFALLGVMAVDRYVAVCNPLRYNIIMNSSTCIWVVIVSWVFGFLSEIWPIYATFQFTFRKSNSLDHFYCDRGQLLKLSCDNTLLTEFILFLMAVFILIGSLIPTIVSYTYIISTILKIPSASGRRKAFSTFASHFTCVVIGYGSCLFLYVKPKQTQGVEYNKIVSLLVSVLTPFLNPFIFTLRNDKVKEALRDGMKRCCQLLKD

SEQ ID NO: 12682 - protein, 314 aa, Artificial Sequence
  Description of Artificial Sequence: Synthetic coding sequence
MLMNYSSATEFYLLGFPGSEELHHILFAIFFFFYLVTLMGNTVIIMIVCVDKRLQSPMYFFLGHLSALEILVTTIIVPVMLWGLLLPGMQTIYLSACVVQLFLYLAVGTTEFALLGAMAVDRYVAVCNPLRYNIIMNRHTCNFVVLVSWVFGFLFQIWPVYVMFQLTYCKSNVVNNFFCDRGQLLKLSCNNTLFTEFILFLMAVFVLFGSLIPTIVSNAYIISTILKIPSSSGRRKSFSTCASHFTCVVIGYGSCLFLYVKPKQTQAADYNWVVSLMVSVVTPFLNPFIFTLRNDKVIEALRDGVKRCCQLFRN

SEQ ID NO: 12683 - protein, 305 aa, Artificial Sequence
  Description of Artificial Sequence: Synthetic coding sequence
MQRSNHTVTEFILLGFTTDPGMQLGLFVVFLGVYSLTVVGNSTLIVLICNDSCLHTPMYFFTGNLSFLDLWYSSVYTPKILVTCISEDKSISFAGCLCQFFFSAGLAYSECYLLAAVAYDRYVAISKPLLYAQAMSIKLCALLVAVSYCGGFINSSIITKKTFSFNFCRENIIDDFFCDLLPLVELACGEKGGYKIMMYFLLASNVICPAVLILASYLFIITSVLRISSSKGYLKAFSTCSSHLTSVTLYYGSILYIYALPRSSYSFDMDKIVSTFYTVVFPMLNLMIYSLRNKDVKEALKKLLP

SEQ ID NO: 12684 - protein, 327 aa, Artificial Sequence
  Description of Artificial Sequence: Synthetic coding sequence
MIFPSHDSQAFTSVDMEVGNCTILTEFILLGFSADSQWQPILFGVFLMLYLITLSGNMTLVILIRTDSHLHTPMYFFIGNLSFLDFWYTSVYTPKILASCVSEDKRISLAGCGAQLFFSCVVAYTECYLLAAMAYDRHAAICNPLLYSGTMSTALCTGLVAGSYIGGFLNAIAHTANTFRLHFCGKNIIDHFFCDAPPLVKMSCTNTRVYEKVLLGVVGFTVLSSILAILISYVNILLAILRIHSASGRHKAFSTCASHLISVMLFYGSLLFMYSRPSSTYSLERDKVAALFYTVINPLLNPLIYSLRNKDIKEAFRKATQTIQPQT

SEQ ID NO: 12685 - protein, 314 aa, Artificial Sequence
  Description of Artificial Sequence: Synthetic coding sequence
MAKNNLTRVTEFILMGFMDHPKLEIPLFLVFLSFYLVTLLGNVGMIMLIQVDVKLYTPMYFFLSHLSLLDACYTSVITPQILATLATGKTVISYGHCAAQFFLFTICAGTECFLLAVMAYDRYAAIRNPLLYTVAMNPRLCWSLVVGAYVCGVSGAILRTTCTFTLSFCKDNQINFFFCDLPPLLKLACSDTANIEIVIIFFGNFVILANASVILISYLLIIKTILKVKSSGGRAKTFSTCASHITAVALFFGALIFMYLQSGSGKSLEEDKVVSVFYTVVIPMLNPLIYSLRNKDVKDAFRKVARRLQVSLSM

SEQ ID NO: 12686 - protein, 335 aa, Artificial Sequence
  Description of Artificial Sequence: Synthetic coding sequence
MLGSKPRVHLYILPCASQQVSTMGDRGTSNHSEMTDFILAGFRVRPELHILLFLLFLFVYAMILLGNVGMMTIIMTDPRLNTPMYFFLGNLSFIDLFYSSVIEPKAMINFWSENKSISFAGCVAQLFLFALLIVTEGFLLAAMAYDRFIAICNPLLYSVQMSTRLCTQLVAGSYFCGCISSVIQTSMTFTLSFCASRAVDHFYCDSRPLQRLSCSDLFIHRMISFSLSCIIILPTIIVIIVSYMYIVSTVLKIHSTEGHKKAFSTCSSHLGVVSVLYGAVFFMYLTPDRFPELSKVASLCYSLVTPMLNPLIYSLRNKDVQEALKKFLEKKNIIL

SEQ ID NO: 12687 - protein, 310 aa, Artificial Sequence
  Description of Artificial Sequence: Synthetic coding sequence
MAEMNLTLVTEFLLIAFTEYPEWALPLFLLFLFMYLITVLGNLEMIILILMDHQLHAPMYFLLSHLAFMDVCYSSITVPQMLAVLLEHGAALSYTRCAAQFFLFTFFGSIDCYLLALMAYDRYLAVCQPLLYVTILTQQARLSLVAGAYVAGLISALVRTVSAFTLSFCGTSEIDFIFCDLPPLLKLTCGESYTQEVLIIMFAIFVIPASMVVILVSYLFIIVAIMGIPAGSQAKTFSTCTSHLTAVSLFFGTLIFMYLRGNSDQSSEKNRVVSVLYTEVIPMLNPLIYSLRNKEVKEALRKILNRAKLS

SEQ ID NO: 12688 - protein, 314 aa, Artificial Sequence
  Description of Artificial Sequence: Synthetic coding sequence
MAERNYTVVTEFFLTAFTEHLQWRVPLFLIFLSFYLATMLGNTGMILLIRGDRRLHTPMYFFLSHLSLVDICYSSAIIPQMLAVLWEHGTTISQARCAAQFFLFTFFASIDCYLLAIMAYDRYTAVCQPLLYVTIITEKARWGLVTGAYVAGFFSAFVRTVTAFTLSFCGNNEINFIFCDLPPLLKLSCGDSYTQEVVIIVFALFVMPACILVILVSYLFIIVAILQIHSAGGRAKTFSTCASHLTAVALFFGTLIFMYLRDNTGQSSEGDRVVSVLYTVVTPMLNPLIYSLRNKEVKEATRKALSKSKPARRP

SEQ ID NO: 12689 - protein, 141 aa, Artificial Sequence
  Description of Artificial Sequence: Synthetic coding sequence
MSFSLNFTLPANTTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 12690 - protein, 130 aa, Artificial Sequence
  Description of Artificial Sequence: Synthetic coding sequence
MSFSLNFTLPANTDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 12691 - protein, 118 aa, Artificial Sequence
  Description of Artificial Sequence: Synthetic coding sequence
MDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 12692 - protein, 131 aa, Artificial Sequence
  Description of Artificial Sequence: Synthetic coding sequence
MRMTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 12693 - protein, 131 aa, Artificial Sequence; identical to SEQ ID NO: 12692
  Description of Artificial Sequence: Synthetic coding sequence

SEQ ID NO: 12694 - protein, 149 aa, Artificial Sequence
  Description of Artificial Sequence: Synthetic coding sequence
METLYRVPFLVLECPNLKLKKPPWLHMPSAMTVYALVVVSYFLITGGIIYDVIVEPPSVGSMTDEHGHQRPVAFLAYRVNGQYIMEGLASSFLFTMGGLGFIILDRSNAPNIPKLNRFLLLFIGFVCVLLSFFMARVFMRMKLPGYLMG

SEQ ID NO: 12695 - protein, 171 aa, Artificial Sequence
  Description of Artificial Sequence: Synthetic coding sequence
METLYRVPFLVLECPNLKLKKPPWLHMPSAMTVYALVVVSYFLITGGIIYDVIVEPPSVGSMTDEHGHQRPVAFLAYRVNGQYIMEGLASSFLFTMGGLGFIILDRSNAPNIPKLNRFLLLFIGFVCVLLSFFMARVFMRMKLPRSLALLPRLECSGVISAHYKLCLPGAI

SEQ ID NO: 12696 - protein, 486 aa, Artificial Sequence
  Description of Artificial Sequence: Synthetic coding sequence
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQLVREEKFIEQPEQIAELTLNSFIQNTEICRS

SEQ ID NO: 12697 - protein, 524 aa, Artificial Sequence
  Description of Artificial Sequence: Synthetic coding sequence
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQALKIREMCNCPPLSNPDPRLLFKLSTKHFLEESEKEDLNITKKQKMDTLPIQKQEQIPLTYIVEKRTGS

SEQ ID NO: 12698 - protein, 255 aa, Artificial Sequence
  Description of Artificial Sequence: Synthetic coding sequence
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTE

SEQ ID NO: 12699 - protein, 328 aa, Artificial Sequence
  Description of Artificial Sequence: Synthetic coding sequence
  MOD_RES (1)..(1): Any amino acid
XLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQLVREEKFIEQPEQIAELTLNSFIQNTEICRS

SEQ ID NO: 12700 - protein, 253 aa, Artificial Sequence
  Description of Artificial Sequence: Synthetic coding sequence
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDML

SEQ ID NO: 12701 - protein, 184 aa, Artificial Sequence
  Description of Artificial Sequence: Synthetic coding sequence
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVV

SEQ ID NO: 12702 - protein, 326 aa, Artificial Sequence
  Description of Artificial Sequence: Synthetic coding sequence
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLG

SEQ ID NO: 12703 - protein, 361 aa, Artificial Sequence [sequence omitted]

SEQ ID NO: 12704 - protein, 377 aa, Artificial Sequence
  Description of Artificial Sequence: Synthetic coding sequence
MSPECARAAGDAPLRSLEQANRTRFPFFSDVKGDHRLVLAAVETTVLVLIFAVSLLGNVCALVLVARRRRRGATACLVLNLFCADLLFISAIPLVLAVRWTEAWLLGPVACHLLFYVMTLSGSVTILTLAAVSLERMVCIVHLQRGVRGPGRRARAVLLALIWGYSAVAALPLCVFFRVVPQRLPGADQEISICTLIWPTIPGEISWDVSFVTLNFLVPGLVIVISYSKILQTSEHLLDARAVVTHSEITKASRKRLTVSLAYSESHQIRVSQQDFRLFRTLFLLMVSFFIMWSPIIITILLILIQNFKQDLVIWPSLFFWVVAFTFANSALNPILYNMTLCRNEWKKIFCCFWFPEKGAILTDTSVKRNDLSIISG

SEQ ID NO: 12705 - protein, 370 aa, Artificial Sequence
  Description of Artificial Sequence: Synthetic coding sequence
MEPLFPAPFWEVIYGSHLQGNLSLLSPNHSLLPPHLLLNASHGAFLPLGLKVTIVGLYLAVCVGGLLGNCLVMYVILRHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPTPQDYWGPVFAICIFLFSFIVPVLVISVCYSLMIRRLRGVRLLSGSREKDRNLRRITRLVLVVVAVFVGCWTPVQVFVLAQGLGVQPSSETAVAILRFCTALGYVNSCLNPILYAFLDENFKACFRKFCCASALRRDVQVSDRVRSIAKDVALACKTSETVPRPA

SEQ ID NO: 12706 - protein, 370 aa, Artificial Sequence; identical to SEQ ID NO: 12705
  Description of Artificial Sequence: Synthetic coding sequence

SEQ ID NO: 12707 - protein, 370 aa, Artificial Sequence; identical to SEQ ID NO: 12705
  Description of Artificial Sequence: Synthetic coding sequence

SEQ ID NO: 12708 - protein, 164 aa, Artificial Sequence
  Description of Artificial Sequence: Synthetic coding sequence
ITGLWSLAIISWERWLVVCKPFGNVRFDAKLAIVGIAFSWIWSAVWTAPPIFGWSRYWPHGLKTSCGPDVFSGSSYPGVQSYMIVLMVTCCIIPLAIIMLCYLQVWLAIRAVAKQQKESESTQKAEKEFRNCILQLFGKKVDDGSELSSASKTEVSSVSSVSPA

SEQ ID NO: 12709 - protein, 364 aa, Artificial Sequence
  Description of Artificial Sequence: Synthetic coding sequence
MAQQWSLQRLAGRHPQDSYEDSTQSSIFTYTNSNSTRGPFEGPNYHIAPRWVYHLTSVWMIFVVIASVFTNGLVLAATMKFKKLRHPLNWILVNLAVADLAETVIASTISVVNQVYGYFVLGHPMCVLEGYTVSLCGITGLWSLAIISWERWMVVCKPFGNVRFDAKLAIVGIAFSWIWAAVWTAPPIFGWSRYWPHGLKTSCGPDVFSGSSYPGVQSYMIVLMVTCCITPLSIIVLCYLQVWLAIRAVAKQQKESESTQKAEKEVTRMVVVMVLAFCFCWGPYAFFACFAAANPGYPFHPLMAALPAFFAKSATIYNPVIYVFMNRQFRNCILQLFGKKVDDGSELSSASKTEVSSVSSVSPA

SEQ ID NO: 12710 - protein, 478 aa, Artificial Sequence
  Description of Artificial Sequence: Synthetic coding sequence
MNPPSGPRVPPSPTQEPSCMATPAPPSWWDSSQSSISSLGRLPSISPTAPGTWAAAWVPLPTVDVPDHAHYTLGTVILLVGLTGMLGNLTVIYTFCRSRSLRTPANMFIINLAVSDFLMSFTQAPVFFTSSLYKQWLFGETGCEFYAFCGALFGISSMITLTAIALDRYLVITRPLATFGVASKRRAAFVLLGVWLYALAWSLPPFFGWSAYVPEGLLTSCSWDYMSFTPAVRAYTMLLCCFVFFLPLLIIIYCYIFIFRAIRETGRALQTFGACKGNGESLWQRQRLQSECKMAKIMLLVILLFVLSWAPYSAVALVAFAGYAHVLTPYMSSVPAVIAKASAIHNPIIYAITHPKYRVAIAQHLPCLGVLLGVSRRHSRPYPSYRSTHRSTLTSHTSNLSWISIRRRQESLGSESEVGWTHMEAAAVWGAAQQANGRSLYGQGLEDLEAKAPPRPQGHEAETPGKTKGLIPSQDPRM

SEQ ID NO: 12711 - protein, 489 aa, Artificial Sequence
  Description of Artificial Sequence: Synthetic coding sequence
MNPPSGPRVPPSPTQEPSCMATPAPPSWWDSSQSSISSLGRLPSISPTAPGTWAAAWVPLPTVDVPDHAHYTLGTVILLVGLTGMLGNLTVIYTFCRAVLRGVTVMMQSRSLRTPANMFIINLAVSDFLMSFTQAPVFFTSSLYKQWLFGETGCEFYAFCGALFGISSMITLTAIALDRYLVITRPLATFGVASKRRAAFVLLGVWLYALAWSLPPFFGWSAYVPEGLLTSCSWDYMSFTPAVRAYTMLLCCFVFFLPLLIIIYCYIFIFRAIRETGRALQTFGACKGNGESLWQRQRLQSECKMAKIMLLVILLFVLSWAPYSAVALVAFAGYAHVLTPYMSSVPAVIAKASAIHNPIIYAITHPKYRVAIAQHLPCLGVLLGVSRRHSRPYPSYRSTHRSTLTSHTSNLSWISIRRRQESLGSESEVGWTHMEAAAVWGAAQQANGRSLYGQGLEDLEAKAPPRPQGHEAETPGKTKGLIPSQDPRM

SEQ ID NO: 12712 - protein, 495 aa, Artificial Sequence
  Description of Artificial Sequence: Synthetic coding sequence
MNPPSGPRVPPSPTQEPSCMATPAPPSWWDSSQSSISSLGRLPSISPTAPGTWAAAWVPLPTVDVPDHAHYTLGTVILLVGLTGMLGNLTVIYTFCRAVLRGVTVMMQSRSLRTPANMFIINLAVSDFLMSFTQAPVFFTSSLYKQWLFGETGCEFYAFCGALFGISSMITLTAIALDRYLVITRPLATFGVASKRRAAFVLLGVWLYALAWSLPPFFGWSAYVPEGLLTSCSWDYMSFTPAVRAYTMLLCCFVFFLPLLIIIYCYIFIFRAIRETGRALQTFGACKGNGESLWQRQRLQSECKMAKIMLLVILLFVLSWAPYSAVALVAFAGYAHVLTPYMSSVPAVIAKASAIHNPIIYAITHPKYRVAIAQHLPCLGVLLGVSRRHSRPYPSYRSTHRSTLTSHTSNLSWISIRRRQESLGSESEVGWTHMEAAAVWGAAQQANGRSLYGQGLEDLEAKAPPRPQGHEAETPGKRRASSGRSQRPERQRAAP

SEQ ID NO: 12713 - protein, 354 aa, Artificial Sequence
  Description of Artificial Sequence: Synthetic coding sequence
MALNHTALPQDERLPHYLRDGDPFASKLSWEADLVAGFYLTIIGILSTFGNGYVLYMSSRRKKKLRPAEIMTINLAVCDLGISVVGKPFTIISCFCHRWVFGWIGCRWYGWAGFFFGCGSLITMTAVSLDRYLKICYLSYGVWLKRKHAYICLAAIWAYASFWTTMPLVGLGDYVPEPFGTSCTLDWWLAQASVGGQVFILNILFFCLLLPTAVIVFSYVKIIAKVKSSSKEVAHFDSRIHSSHVLEMKLTKVAMLICAGFLIAWIPYAVVSVWSAFGRPDSIPIQLSVVPTLLAKSAAMYNPIIYQVIDYKFACCQTGGLKATKKKSLEGFRLHTVTTVRKSSAVLEIHEEWE

SEQ ID NO: 12714 - protein, 379 aa, Artificial Sequence
  Description of Artificial Sequence: Synthetic coding sequence
MSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEEEQAALTRPEELSYEVINIQATQDQQRSEELARIMGEFEITEQPRLSTSKGDDLLAMMDEL

SEQ ID NO: 12715 - protein, 339 aa, Artificial Sequence
  Description of Artificial Sequence: Synthetic coding sequence
MSVRTLPLLFLNLGGEMLYILDQRLRAQNIPGDKARKDEWTEVDRKRVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEGDDLLAMMDEL

SEQ ID NO: 12716 - protein, 223 aa, Artificial Sequence
  Description of Artificial Sequence: Synthetic coding sequence
MSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRRECFWKHMQETVHSAQCCLPGVGNYMEDRRRRLTFHYVYPFENFEFCTWAK

SEQ ID NO: 12717 - protein, 389 aa, Artificial Sequence
  Description of Artificial Sequence: Synthetic coding sequence
MSVRTLPLLFLNLGGEMLYILDQRLRAQNIPGDKARKDEWTEVDRKRVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEEEQAALTRPEELSYEVINIQATQDQQRSEELARIMGEFEITEQPRLSTSKGDDLLAMMDEL

SEQ ID NO: 12718 - protein, 340 aa, Artificial Sequence
  Description of Artificial Sequence: Synthetic coding sequence
MEPGRTQIKLDPRYTADLLEVLKTNYGIPSACFSQPPTAAQLLRALGPVELALTSILTLLALGSIAIFLEDAVYLYKNTLCPIKRRTLLWKSSAPTVVSVLCCFGLWIPRSLVLVEMTITSFYAVCFYLLMLVMVEGFGGKEAVLRTLRDTPMMVHTGPCCCCCPCCPRLLLTRKKLQLLMLGPFQYAFLKITLTLVGLFLVPDGIYDPADISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNLKA

SEQ ID NO: 12719 - protein, 128 aa, Artificial Sequence
  Description of Artificial Sequence: Synthetic coding sequence
MEHSEGAPGDPAGTVVPQELLEEMLWFFRVEDASPWNHSILALAAVVVIISMVLLGRSIQASRKEKMQPPEKETPEVLHLDEAKDHNSLNNLRETLLSEKPNLAQVELELKERDVLSVFLPDVPETES

SEQ ID NO: 12720 - protein, 414 aa, Artificial Sequence
  Description of Artificial Sequence: Synthetic coding sequence
MLILTKTAGVFFKPSKRKVYEFLRSFNFHPGTLFLHKIVLGIETSCDDTAAAVVDETGNVLGEAIHSQTEVHLKTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDKVARRLSLIKHPECSTMSGGKAIEHLAKQGNRFHFDIKPPLHHAKNCDFSFTGLQHVTDKIIMKKEKEEGIEKGQILSSAADIAATVQHTMACHLVKRTHRAILFCKQRDLLPQNNAVLVASGGVASNFYIRRALEILTNATQCTLLCPPPRLCTDNGIMIAWNGIERLRAGLGILHDIEGIRYEPKCPLGVDISKEVGEASIKVPQLKMEI

SEQ ID NO: 12721 - protein, 222 aa, Artificial Sequence
  Description of Artificial Sequence: Synthetic coding sequence
MLILTKTAGVFFKPSKRKVYEFLRSFNFHPGTLFLHKIVLGIETSCDDTAAAVVDETGNVLGEAIHSQTEVHLKTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDKVARRLSLIKHPECSTMSGG

SEQ ID NO: 12722 - protein, 203 aa, Artificial Sequence
  Description of Artificial Sequence: Synthetic coding sequence
MLILTKTAGVFFKPSKRKVYEFLRSFNFHPGTLFLHKIVLGIETSCDDTAAAVVDETGNVLGEAIHSQTEVHLKTGGIVPPAAQQLHRENIQRIVQEALSASGVSPSDLSAIATTIKPGLALSLGVGLSFSLQLVGQLKKPFIPIHHMEAHALTIRLTNKVEFPFLVLLISGGHCLLALVQGVSDFLLLGKSLDIAPGDMLDK

SEQ ID NO: 12723 - protein, 414 aa, Artificial Sequence; identical to SEQ ID NO: 12720
  Description of Artificial Sequence: Synthetic coding sequence

SEQ ID NO: 12724 - protein, 562 aa, Artificial Sequence
  Description of Artificial Sequence: Synthetic coding sequence
MSEELAQGPKESPPAPRAGPREVWKKGGRLLSVLLAVNVLLLACTLISGGAFNKVAVYDTDVFALLTAMMLLATLWILFYLLRTVRCPCAVPYRDAHAGPIWLRGGLVLFGICTLIMDVFKTGYYSSFFECQSAIKILHPLIQAVFVIIQTYFLWVSAKDCVHVHLDLTWCGLMFTLTTNLAIWMAAVVDESVHQSHSYSSSHSNASHARLISDQHADNPVGGDSCLCSTAVCQIFQQGYFYLYPFNIEYSLFASTMLYVMWKNVGRFLASTPGHSHTPTPVSLFRETFFAGPVLGLLLFVVGLAVFIIYEVQVSGDGSRTRQALVIYYSFNIVCLGLTTLVSLSGSIIYRFDRRAMDHHKNPTRTLDVALLMGAALGQYAISYYSIVAVVAGTPQDLLAGLNLTHALLMIAQHTFQNMFIIESLHRGPPGAEPHSTHPKEPCQDLTFTNLDALHTLSACPPNPGLVSPSPSDQREAVAIVSTPRSQWRRQCLKDISLFLLLCNVILWIMPAFGARPHFSNTVEVDFYGYSLWAVIVNICLPFGIFYRMHAVSSLLEVYVLS

SEQ ID NO: 12725 - protein, 596 aa, Artificial Sequence
  Description of Artificial Sequence: Synthetic coding sequence
MGRGARAAAAQSRWGRASRASVSPGRTIRSAPAVGEAQETEAAPEKENRVDVGAEERAAATRPRQKSWLVRHFSLLLRRDRQAQKAGQLFSGLLALNVVFLGGAFICSMIFNKVAVTLGDVWILLATLKVLSLLWLLYYVASTTRRPHAVLYQDPHAGPLWVRGSLVLFGSCTFCLNIFRVGYDVSHIRCKSQLDLVFSVIEMVFIGVQTWVLWKHCKDCVRVQTNFTRCGLMLTLATNLLLWVLAVTNDSMHREIEAELGILMEKSTGNETNTCLCLNATACEAFRRGFLMLYPFSTEYCLICCAVLFVMWKNVGRHVAPHMGAHPATAPFHLHGAIFGPLLGLLVLLAGVCVFVLFQIEASGPAIACQYFTLYYAFYVAVLPTMSLACLAGTAIHGLEERELDTVKNPTRSLDVVLLMGAALGQMGIAYFSIVAIVAKRPHELLNRLILAYSLLLILQHIAQNLFIIEGLHRRPLWETVPEGLAGKQEAEPPRRGSLLELGQGLQRASLAYIHSYSHLNWKRRALKEISLFLILCNITLWMMPAFGIHPEFENGLEKDFYGYQIWFAIVNFGLPLGVFYRMHSVGGLVEVYLGA

SEQ ID NO: 12726 - protein, 312 aa, Artificial Sequence
  Description of Artificial Sequence: Synthetic coding sequence
MACAAVMIPGLLRCSVGAIRIEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRNLVLIAGGVGINPLLSILRHAADLLREQANKRNGYEIGTIKLFYSAKNTSELLFKKNILDLVNEFPEKIACSLHVTKQTTQINAELKPYITEGRITEKEIRDHISKETLFYICGPPPMTDFFSKQLENNHVPKEHICFEKWW

SEQ ID NO: 12727 - protein, 161 aa, Artificial Sequence
  Description of Artificial Sequence: Synthetic coding sequence
MACAAVMIPGLLRCSVGAIRIEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDCEVAVRVGGEFFF

SEQ ID NO: 12728 - protein, 330 aa, Artificial Sequence
  Description of Artificial Sequence: Synthetic coding sequence
MTPKISWTSKFSVCPESAMACAAVMIPGLLRCSVGAIRIEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRNLVLIAGGVGINPLLSILRHAADLLREQANKRNGYEIGTIKLFYSAKNTSELLFKKNILDLVNEFPEKIACSLHVTKQTTQINAELKPYITEGRITEKEIRDHISKETLFYICGPPPMTDFFSKQLENNHVPKEHICFEKWW

SEQ ID NO: 12729 - protein, 423 aa, Artificial Sequence
  Description of Artificial Sequence: Synthetic coding sequence
MLCHRGGQLIVPIIPLCPEHSCRGRRLQNLLSGPWPKQPMELHNLSSPSPSLSSSVLPPSFSPSPSSAPSAFTTVGGSSGGPCHPTSSSLVSAFLAPILALEFVLGLVGNSLALFIFCIHTRPWTSNTVFLVSLVAADFLLISNLPLRVDYYLLHETWRFGAAACKVNLFMLSTNRTASVVFLTAIALNRYLKVVQPHHVLSRASVGAAARVAGGLWVGILLLNGHLLLSTFSGPSCLSYRVGTKPSASLRWHQALYLLEFFLPLALILFAIVSIGLTIRNRGLGGQAGPQRAMRVLAMVVAVYTICFLPSIIFGMASMVAFWLSACRSLDLCTQLFHGSLAFTYLNSVLDPVLYCFSSPNFLHQSRALLGLTRGRQGPVSDESSYQPSRQWRYREASRKAEAIGKLKVQGEVSLEKEGSSQG

SEQ ID NO: 12730 - protein, 337 aa, Artificial Sequence
  Description of Artificial Sequence: Synthetic coding sequence
MNEPLDYLANASDFPDYAAAFGNCTDENIPLKMHYLPVIYGIIFLVGFPGNAVVISTYIFKMRPWKSSTIIMLNLACTDLLYLTSLPFLIHYYASGENWIFGDFMCKFIRFSFHFNLYSSILFLTCFSIFRYCVIIHPMSCFSIHKTRCAVVACAVVWIISLVAVIPMTFLITSTNRTNRSACLDLTSSDELNTIKWYNLILTATTFCLPLVIVTLCYTTIIHTLTHGLQTDSCLKQKARRLTILLLLAFYVCFLPFHILRVIRIESRLLSISCSIENQIHEAYIVSRPLAALNTFGNLLLYVVVSDNFQQAVCSTVRCKVSGNLEQAKKISYSNNP

SEQ ID NO: 12731 - protein, 62 aa, Artificial Sequence
  Description of Artificial Sequence: Synthetic coding sequence
MNEPLDYLANASDFPDYAAAFGNCTDENIPLKMHYLPVIYGIIFLVGFPGNAVVISTYIFKM

SEQ ID NO: 12732 - protein, 69 aa, Artificial Sequence
  Description of Artificial Sequence: Synthetic coding sequence
MNEPLDYLANASDFPDYAAAFGNCTDENIPLKMHYLPVIYGIIFLVGFPGNAVVISTYIFKMRPWKSST

SEQ ID NO: 12733 - protein, 337 aa, Artificial Sequence; identical to SEQ ID NO: 12730
  Description of Artificial Sequence: Synthetic coding sequence

SEQ ID NO: 12734 - protein, 1010 aa, Artificial Sequence
  Description of Artificial Sequence: Synthetic coding sequence
MSQLRLLPSRLGVQAARLLAAHDVPVFGWRSRSSGPPATFPSSKGGGGSSYMEEMYFAWLENPQSVHKSWDSFFREASEEAFSGSAQPRPPSVVHESRSAVSSRTKTSKLVEDHLAVQSLIRAYQIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 12735 - protein, 953 aa, Artificial Sequence
  Description of Artificial Sequence: Synthetic coding sequence
MSQLRLLPSRLGVQAARLLAAHDVPVFGWRSRSSGPPATFPSSKGGGGSSYMEEMYFAWLENPQSVHKIRGHHVAQLDPLGILDADLDSFVPSDLITTIDKLAFYDLQEADLDKEFQLPTTTFIGGSENTLSLREIIRRLENTYCQHIGLEFMFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 12736 - protein, 801 aa, Artificial Sequence
  Description of Artificial Sequence: Synthetic coding sequence
MFINDVEQCQWIRQKFETPGVMQFSSEEKRTLLARLVRSMRFEDFLARKWSSEKRFGLEGCEVMIPALKTIIDKSSEMGIENVILGMPHRGRLNVLANVIRKDLEQIFCQFDPKLEAADEGSGDVKYHLGMYHERINRVTNRNITLSLVANPSHLEAVDPVVQGKTKAEQFYRGDAQGKKVMSILVHGDAAFAGQGVVYETFHLSDLPSYTTNGTVHVVVNNQIGFTTDPRMARSSPYPTDVARVVNAPIFHVNADDPEAVIYVCSVAAEWRNTFNKDVVVDLVCYRRRGHNEMDEPMFTQPLMYKQIHRQVPVLKKYADKLIAEGTVTLQEFEEEIAKYDRICEEAYGRSKDKKILHIKHWLDSPWPGFFNVDGEPKSMTCPATGIPEDMLTHIGSVASSVPLEDFKIHTGLSRILRGRADMTKNRTVDWALAEYMAFGSLLKEGIHVRLSGQDVERGTFSHRHHVLHDQEVDRRTCVPMNHLWPDQAPYTVCNSSLSEYGVLGFELGYAMASPNALVLWEAQFGDFHNTAQCIIDQFISTGQAKWVRHNGIVLLLPHGMEGMGPEHSSARPERFLQMSNDDSDAYPAFTKDFEVSQLYDCNWIVVNCSTPANYFHVLRRQILLPFRKPLIIFTPKSLLRHPEAKSSFDQMVSGTSFQRVIPEDGAAARAPEQVQRLIFCTGKVYYDLVKERSSQDLEEKVAITRLEQISPFPFDLIKQEAEKYPGAELAWCQEEHKNMGYYDYISPRFMTILRRARPIWYVGRDPAAAPATGNRNTHLVSLKKFLDTAFNLQAFEGKTF

SEQ ID NO: 12737 - protein, 719 aa, Artificial Sequence
  Description of Artificial Sequence: Synthetic coding sequence
MFGKKKKKIEISGPSNFEHRVHTGFDPQEQKFTGLPQQWHSLLADTANRPKPMVDPSCITPIQLAPMKTIVRGNKPCKETSINGLLEDFDNISVTRSNSLRKESPPTPDQGASSHGPGHAEENGFITFSQYSSESDTTADYTTEKYREKSLYGDDLDPYYRGSHAAKQNGHVMKMKHGEAYYSEVKPLKSDFARFSADYHSHLDSLSKPSEYSDLKWEYQRASSSSPLDYSFQFTPSRTAGTSGCSKESLAYSESEWGPSLDDYDRRPKSSYLNQTSPQPTMRQRSRSGSGLQEPMMPFGASAFKTHPQGHSYNSYTYPRLSEPTMCIPKVDYDRAQMVLSPPLSGSDTYPRGPAKLPQSQSKSGYSSSSHQYPSGYHKATLYHHPSLQSSSQYISTASYLSSLSLSSSTYPPPSWGSSSDQQPSRVSHEQFRAALQLVVSPGDPREYLANFIKIGEGSTGIVCIATEKHTGKQVAVKKMDLRKQQRRELLFNEVVIMRDYHHDNVVDMYSSYLVGDELWVVMEFLEGGALTDIVTHTRMNEEQIATVCLSVLRALSYLHNQGVIHRDIKSDSILLTSDGRIKLSDFGFCAQVSKEVPKRKSLVGTPYWMAPEVISRLPYGTEVDIWSLGIMVIEMIDGEPPYFNEPPLQAMRRIRDSLPPRVKDLHKVSSVLRGFLDLMLVREPSQRATAQELLGHPFLKLAGPPSCIVPLMRQYRHH

SEQ ID NO: 12738 - protein, 719 aa, Artificial Sequence; identical to SEQ ID NO: 12737
  Description of Artificial Sequence: Synthetic coding sequence

SEQ ID NO: 12739 - protein, 719 aa, Artificial Sequence; identical to SEQ ID NO: 12737
  Description of Artificial Sequence: Synthetic coding sequence

SEQ ID NO: 12740 - protein, 580 aa, Artificial Sequence
  Description of Artificial Sequence: Synthetic coding sequence
MVDPSCITPIQLAPMKTIVRGNKPCKETSINGLLEDFDNISVTRSNSLRKESPPTPDQGASSHGPGHAEENGFITFSQYSSESDTTADYTTEKYREKSLYGDDLDPYYRGSHAAKQNGHVMKMKHGEAYYSEVKPLKSDFARFSADYHSHLDSLSKPSEYSDLKWEYQRASSSSPLDYSFQFTPSRTAGTSGCSKESLAYSESEWGPSLDDYDRRPKSSYLNQTSPQPTMRQRSRSGSGLQEPMMPFGASAFKTHPQGHSYNSYTYPRLSEPTMCIPKVDYDRAQMVLSPPLSGSDTYPRGPAKLPQSQSKSGYSSSSHQYPSGYHKATLYHHPSLQSSSQYISTASYLSSLSLSSSTYPPPSWGSSSDQQPSRVSHEQFRAALQLVVSPGDPREYLANFIKIGEGSTGIVCIATEKHTGKQVAVKKMDLRKQQRRELLFNEVVIMRDYHHDNVVDMYSSYLVGDELWVVMEFLEGGALTDIVTHTRMNEEQIATVCLSVLRALSYLHNQGVIHRDIKSDSILLTSDGRVSSVLRGFLDLMLVREPSQRATAQELLGHPFLKLAGPPSCIVPLMRQYRHH

SEQ ID NO: 12741 - protein, 426 aa, Artificial Sequence
  Description of Artificial Sequence: Synthetic coding sequence
MAIAQLATEYVFSDFLLKEPTEPKFKGLRLELAVDKMVTCIAVGLPLLLISLAFAQEISIGTQISCFSPSSFSWRQAAFVDSYCWAAVQQKNSLQSESGNLPLWLHKFFPYILLLFAILLYLPPLFWRFAAAPHICSDLKFIMEELDKVYNRAIKAAKSARDLDMRDGACSVPGVTENLGQSLWEVSESHFKYPIVEQYLKTKKNSNNLIIKYISCRLLTLIIILLACIYLGYYFSLSSLSDEFVCSIKSGILRNDSTVPDQFQCKLIAVGIFQLLSVINLVVYVLLAPVVVYTLFVPFRQKTDVLKVYEILPTFDVLHFKSEGYNDLSLYNLFLEENISEVKSYKCLKVLENIKSSGQGIDPMLLLTNLGMIKMDVVDGKTPMSAEMREEQGNQTAELQGMNIDSETKANNGEKNARQRLLDSSC

SEQ ID NO: 12742 - protein, 422 aa, Artificial Sequence
  Description of Artificial Sequence: Synthetic coding sequence
MAIAQLATEYVFSDFLLKEPTEPKFKGLRLELAVDKMVTCIAVGLPLLLISLAFAQEISIGTQISCFSPSSFSWRQAAFVDSYCWAAVQQKNSLQSESGNLPLWLHKFFPYILLLFAILLYLPPLFWRFAAAPHICSDLKFIMEELDKVYNRAIKAAKSARDLDMRDGACSVPGVTENLGQSLWEVSESHFKYPIVEQYLKTKKNSNNLIIKYISCRLLTLIIILLACIYLGYYFSLSSLSDEFVCSIKSGILRNDSTVPDQFQCKLIAVGIFQLLSVINLVVYVLLAPVVVYTLFVPFRQKTDVLKVYEILPTFDVLHFKSEGYNDLSLYNLFLEENISEVKSYKCLKVLENIKSSGQGIDPMLLLTNLGMIKMDVVDGKTPMSAEMREEQGNQTAELQDSETKANNGEKNARQRLLDSSC

SEQ ID NO: 12743 - protein, 677 aa, Artificial Sequence
  Description of Artificial Sequence: Synthetic coding sequence
MHHLLEQSADMATALLAGEKLRELILPGAQDDKAGALAALLLQLKLELPFDRVVTIGTVLVPILLVTLVFTKNFAEEPIYCYTPHNFTRDQALYARGYCWTELRDALPGVDASLWPSLFEHKFLPYALLAFAAIMYVPALGWEFLASTRLTSELNFLLQEIDNCYHRAAEGRAPKIEKQIQSKGPGITEREKREIIENAEKEKSPEQNLFEKYLERRGRSNFLAKLYLARHVLILLLSAVPISYLCTYYATQKQNEFTCALGASPDGAAGAGPAVRVSCKLPSVQLQRIIAGVDIVLLCVMNLIILVNLIHLFIFRKSNFIFDKLHKVGIKTRRQWRRSQFCDINILAMFCNENRDHIKSLNRLDFITNESDLMYDNVVRQLLAALAQSNHDATPTVRDSGVQTVDPSANPAEPDGAAEPPVVKRPRKKMKWIPTSNPLPQPFKEPLAIMRVENSKAEKPKPARRKTATDTLIAPLLDRSAHHYKGGGGDPGPGPAPAPAPPPAPDKKHARHFSLDVHPYILGTKKAKAEAVPAALPASRSQEGGFLSQAEDCGLGLAPAPIKDAPLPEKEIPYPTEPARAGLPSGGPFHVRSPPAAPAVAPLTPASLGKAEPLTILSRNATHPLLHINTLYEAREEEDGGPRLPQDVGDLIAIPAPQQILIATFDEPRTVVSTVEF

SEQ ID NO: 12744 - protein, 354 aa, Artificial Sequence
  Description of Artificial Sequence: Synthetic coding sequence
MNLIILVNLIHLFIFRKSNFIFDKLHKVGIKTRRQWRRSQFCDINILAMFCNENRDHIKSLNRLDFITNESDLMYDNVVRQLLAALAQSNHDATPTVRDSGVQTVDPSANPAEPDGAAEPPVVKRPRKKMKWIPTSNPLPQPFKEPLAIMRVENSKAEKPKPARRKTATDTLIAPLLDRSAPDKKHARHFSLDVHPYILGTKKAKAEAVPAALPASRSQEGGFLSQAEDCGLGLAPAPIKDAPLPEKEIPYPTEPARAGLPSGGPFHVRSPPAAPAVAPLTPASLGKAEPLTILSRNATHPLLHINTLYEAREEEDGGPRLPQDVGDLIAIPAPQQILIATFDEPRTVVSTVEF

SEQ ID NO: 12745 - protein, 392 aa, Artificial Sequence
  Description of Artificial Sequence: Synthetic coding sequence
MSLAHTAAEYMLSDALLPDRRGPRLKGLRLELPLDRIVKFVAVGSPLLLMSLAFAQEFSSGSPISCFSPSNFSIRQAAYVDSSCWDSLLHHKQDGPGQDKMKSLWPHKALPYSLLALALLMYLPVLLWQYAAVPALSSDLLFIISELDKSYNRSIRLVQHMLKIRQKSSDPYVFWNELEKARKERYFEFPLLERYLACKQRSHSLVATYLLRNSLLLIFTSATYLYLGHFHLDVFFQEEFSCSIKTGLLSDETHVPNLITCRLTSLSIFQIVSLSSVAIYTILVPVIIYNLTRLCRWDKRLLSVYEMLPAFDLLSRKMLGCPINDLNVILLFLRANISELISFSWLSVLCVLKDTTTQKHNIDTVVDFMTLLAGLEPSKPKHLTNSACDEHP

SEQ ID NO: 12746 - protein, 102 aa, Artificial Sequence
  Description of Artificial Sequence: Synthetic coding sequence
MRYGFVRKKHRGLFLTTVAALPIWNPISEFVKWYKSHKLSQHCIRICGHLCQKHLDMFLSVIGQRWPIDVFSSVFDHQVSAIGSDIIWWFLKLFLVSFFFFF

SEQ ID NO: 12747 - protein, 1104 aa, Artificial Sequence
  Description of Artificial Sequence: Synthetic coding sequence
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERESGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 12748 - protein, 1136 aa, Artificial Sequence
  Description of Artificial Sequence: Synthetic coding sequence
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSDGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 12749 - protein, 1143 aa, Artificial Sequence
  Description of Artificial Sequence: Synthetic coding sequence
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 12750 - protein, 1205 aa, Artificial Sequence
  Description of Artificial Sequence: Synthetic coding sequence
MKVTVCFGRTGIVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKDGRLRMNDQLIAVNGESLLGKSNHEAMETLRRSMSMEGNIRGMIQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 12751 - protein, 346 aa, Artificial Sequence
  Description of Artificial Sequence: Synthetic coding sequence
MARPQRTPARSPDSIVEVKSKFDAEFRRFALPRASVSGFQEFSRLLRAVHQIPGLDVLLGYTDAHGDLLPLTNDDSLHRALASGPPPLRLLVQKRAEADSSGLAFASNSLQRRKKGLLLRPVAPLRTRPPLLISLPQDFRQVSSVIDVDLLPETHRRVRLHKHGSDRPLGFYIRDGMSVRVAPQGLERVPGIFISRLVRGGLAESTGLLAVSDEILEVNGIEVAGKTLDQVTDMMVANSHNLIVTVKPANQRNNVVRGASGRLTGPPSAGPGPAEPDSDDDSSDLVIENRQPPSSNGLSQGPPCWDLHPGCRHPGTRSSLPSLDDQEQASSGWGSRIRGDGSGFSL

SEQ ID NO: 12752 - protein, 345 aa, Artificial Sequence
  Description of Artificial Sequence: Synthetic coding sequence
MARPQRTPARSPDSIVEVKSKFDAEFRRFALPRASVSGFQEFSRLLRAVHQIPGLDVLLGYTDAHGDLLPLTNDDSLHRALASGPPPLRLLVQKREADSSGLAFASNSLQRRKKGLLLRPVAPLRTRPPLLISLPQDFRQVSSVIDVDLLPETHRRVRLHKHGSDRPLGFYIRDGMSVRVAPQGLERVPGIFISRLVRGGLAESTGLLAVSDEILEVNGIEVAGKTLDQVTDMMVANSHNLIVTVKPANQRNNVVRGASGRLTGPPSAGPGPAEPDSDDDSSDLVIENRQPPSSNGLSQGPPCWDLHPGCRHPGTRSSLPSLDDQEQASSGWGSRIRGDGSGFSL

SEQ ID NO: 12753 - protein, 343 aa, Artificial Sequence
  Description of Artificial Sequence: Synthetic coding sequence
MEVLAAETTSQQERLQAIAEKRKRQAEIENKRRQLEDERRQLQHLKSKALRERWLLEGTPSSASEGDEDLRRQMQDDEQKTRLLEDSVSRLEKEIEVLERGDSAPATAKENAAAPSPVRAPAPSPAKEERKTEVVMNSQQTPVGTPKDKRVSNTPLRTVDGSPMMKAVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIM

SEQ ID NO: 12754 - protein, 387 aa, Artificial Sequence
  Description of Artificial Sequence: Synthetic coding sequence
MEVLAAETTSQQERLQAIAEKRKRQAEIENKRRQLEDERRQLQHLKSKALRERWLLEGTPSSASEGDEDLRRQMQDDEQKTRLLEDSVSRLEKEIEVLERGDSAPATAKENAAAPSPVRAPAPSPAKEERKTEVVMNSQQTPVGTPKDKRVSNTPLRTVDGSPMMKAAMYSVEITVEKDKVTGETRVLSSTTLLPRQPLPLGIKVYEDETKVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIM

SEQ ID NO: 12755 - protein, 252 aa, Artificial Sequence
  Description of Artificial Sequence: Synthetic coding sequence
MNSQQTPVGTPKDKRVSNTPLRTVDGSPMMKAAMYSVEITVEKDKVTGETRVLSSTTLLPRQPLPLGIKVYEDETKVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIM

SEQ ID NO: 12756 - protein, 353 aa, Artificial Sequence
  Description of Artificial Sequence: Synthetic coding sequence
MAMTLLEDWCRGMDVNSQRALLVWGIPVNCDEAEIEETLQAAMPQVSYRMLGRMFWREENAKAALLELTGAVDYAAIPREMPGKGGVWKVLFKPPTSDAEFLERLHLFLAREGWTVQDVARVLGFQNPTPTPGPEMPAEMLNYILDNVIQPLVESIWYKRLTLFSGRDIPGPGEETFDPWLEHTNEVLEEWQVSDVEKRRRLMESLRGPAADVIRILKSNNPAITTAECLKALEQVFGSVESSRDAQIKFLNTYQNPGEKLSAYVIRLEPLLQKVVEKGAIDKDNVNQARLEQVIAGANHSGAIRRQLWLTGAGEGPAPNLFQLLVQIREEEAKEEEEEAEATLLQLGLEGHF

SEQ ID NO: 12757 - protein, 593 aa, Artificial Sequence
  Description of Artificial Sequence: Synthetic coding sequence
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGLPAVFVAVWVSVRATLANTGCWDLSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 12758 - protein, 593 aa, Artificial Sequence; identical to SEQ ID NO: 12757
  Description of Artificial Sequence: Synthetic coding sequence

SEQ ID NO: 12759 - protein, 527 aa, Artificial Sequence
  Description of Artificial Sequence: Synthetic coding sequence
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGLPAVFVAVWVSVRATLANTGCWDLSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTAT

SEQ ID NO: 12760 - protein, 333 aa, Artificial Sequence
  Description of Artificial Sequence: Synthetic coding sequence
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGAGT

SEQ ID NO: 12761 - protein, 593 aa, Artificial Sequence; identical to SEQ ID NO: 12757
  Description of Artificial Sequence: Synthetic coding sequence

SEQ ID NO: 12762 - protein, 593 aa, Artificial Sequence; identical to SEQ ID NO: 12757
  Description of Artificial Sequence: Synthetic coding sequence

SEQ ID NO: 12763 - protein, 550 aa, Artificial Sequence
  Description of Artificial Sequence: Synthetic coding sequence
MAGLGASLHVWGWLMLGSCLLARAQLDSDGTITIEEQIVLVLKAKVQCELNITAQLQEGEGNCFPEWDGLICWPRGTVGKISAVPCPPYIYDFNHKGVAFRHCNPNGTWDFMHSLNKTWANYSDCLRFLQPDISIGKQEFFERLYVMYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSTLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 12764 - protein, 114 aa, Artificial Sequence
  Description of Artificial Sequence: Synthetic coding sequence
MSALSLLILGLLTAVPPASCQQGLGNLQPWMQGLIAVAVFLVLVAIAFAVNHFWCQEEPEPAHMILTVGNKADGVLVGTDGRYSSMAASFRSSEHENAYENVPEEEGKVRSTPM

SEQ ID NO: 12765 - protein, 114 aa, Artificial Sequence; identical to SEQ ID NO: 12764
  Description of Artificial Sequence: Synthetic coding sequence

SEQ ID NO: 12766 - protein, 2269 aa, Artificial Sequence
  Description of Artificial Sequence: Synthetic coding sequence
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVRNGSVHLEASHDNASAVGGSSLHDELGKFSSTLYETGGCDMSLVNFEPAARRASNICDTDSHVSSSTSVRFYPHDVLSLPQIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSRKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 12767 - protein, 2341 aa, Artificial Sequence
  Description of Artificial Sequence: Synthetic coding sequence
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVRNGSVHLEASHDNASAVGGSSLHDELGKFSSTLYETGGCDMSLVNFEPAARRASNICDTDSHVSSSTSVRFYPHDVLSLPQIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSRKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 12768 - protein, 2230 aa, Artificial Sequence
  Description of Artificial Sequence: Synthetic coding sequence
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGGKFSSTLYETGGCDMSLVNFEPAARRASNICDTDSHVSSSTSVRFYPHDVIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSRKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 12769 - protein, 1328 aa, Artificial Sequence
  Description of Artificial Sequence: Synthetic coding sequence
  MOD_RES (1)..(1): Any amino acid
XDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSRKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 12770 - protein, 2137 aa, Artificial Sequence
  Description of Artificial Sequence: Synthetic coding sequence
MVSQVLQLLRQGVWAALTGGWYHDPEQSKFTNSCHLYLWLFLLLLPLALHLAFPPNAIIVFFYCSAVTIFFTIIKLVSYRLHLMFDKGEVIQQKPSRKEEKPNKDKEAKGEHITNHRNPSNNRQIHNGKKEEASRNLSTPPLRCSSRGQSITSHHSSGPLELSAQETVEDLKGVILLEDHPIAPVSSTSPGIKVESLPASQAHMLETTTKSVIPVKPVATETLINGKGKERGGKGQPPLRHRSEGGLVDKGPLKKLPHLSLSQYDLLETDVSFQPWGSENSVLIPEPVSCPRGSIRERVQSKSPQDSLSSSCPQCDTIVAKPVEEPADTSCQVDTSCQGDLPLHQEVDSSDSEVAVTLIDTSQPGDPLSLHEPIKIVITMSSTPNSMTDLESSLHLRVVGTEKTSVKSDAEPTNPGAAGSPNAEQISIPVITLDLPEGGGGGVPCPEGNGSERTPERLKTRVSTNQCSGYGSGEGGNAIKDHSSSSREPWESVSRLTPDTGSESKVGKEGQTNLDPSSCKSSHEKRHARVLSVDSGTDVFLSKSSAEIVNDTEKTMPTSKSDLEAKEGQMPNESNFLEFVSLLESINTSKMTASSQLNGSAEQNEESGLLRDNCSQEKKEEILENEKPSGHSSKQGKPDLQSQDHTSTGPACTQPAKTTAFFQGNRQRQIIYRVTSQQDSSVLQVISGPETSVQEEISVDAMHVFIDEHGEIRSCYLKSGNQKEGPLQPLPSNNDCLSQAREMQVSSSSTTTSESQDPSSGDPAVSALQQQLLLMVARRTQSETPRHVSQDLEASSCSSTQGKFNREQFYKFIIFPGKWIKVWYDRLTLLALLDRTEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKLGDLLHKLQFVLTYVAPWQMAWGSSFHVFAQLFAIPHSAMLFFQTIATSIFSTPLSPFLGSVIFITSYVRPVKFWEKNYNTRRVDNSNTRLAVQIERDPGNDDNNLNSIFYEHLTRTLQESLCGDLVLGRWGNYSSGDCFILASDDLNAFVHLIEIGNGLVTFQLRGLEFRGTYCQQREVEAIMEGDEEDRGCCCCKPGHLPHLLSCNAAFHLRWLTWEITQTQYILEGYSILDNNAATMLQVFDLRRILIRYYIKSIIYYMVTSPKLLSWIKNESLLKSLQPFAKWHYIERDLAMFNINIDDDYVPCLQGITRASFCNVYLEWIQHCARKRQEPSTTLDSDEDSPLVTLSFALCTLGRRALGTAAHNMAISLDSFLYGLHVLFKGDFRITARDEWVFADMDLLHKVVAPAIRMSLKLHQDQFTCPDEYEDPAVLYEAIQSFEKKVVICHEGDPAWRGAVLSNKEELLTLRHVVDEGADEYKVIMLHRSFLSFKVIKVNKECVRGLWAGQQQELIFLRNRNPERGSIQNNKQVLRNLINSSCDQPLGYPMYVSPLTTSYLGTHRQLKNIWGGPITLDRIRTWFWTKWVRMRKDCNARQHSGGNIEDVDGGGAPTTGGNNAPSGGSQESSAEQPRKGGAQHGVSSCEGTQRTGRRKGRSQSVQAHSALSQRPPMLSSSGPILESRQTFLQTSTSVHELAQRLSGSRLSLHASATSLHSQPPPVTTTGHLSVRERAEALIRSSLGSSTSSTLSFLFGKRSFSSALVISGLSAAEGGNTSDTQSSSSVNIVMGPSARAASQATRHLSEPCEPPDATEQGQLHDRCLAEAVADTLGVVCRRASQEDMGLDDTASQQSVSDEQ

SEQ ID NO: 12771 - protein, 777 aa, Artificial Sequence
  Description of Artificial Sequence: Synthetic coding sequence
MTFYPFVASSSTRRVDNSNTRLAVQIERDPGNDDNNLNSIFYEHLTRTLQESLCGDLVLGRWGNYSSGDCFILASDDLNAFVHLIEIGNGLVTFQLRGLEFRGTYCQQREVEAIMEGDEEDRGCCCCKPGHLPHLLSCNAAFHLRWLTWEITQTQYILEGYSILDNNAATMLQVFDLRRILIRYYIKSIIYYMVTSPKLLSWIKNESLLKSLQPFAKWHYIERDLAMFNINIDDDYVPCLQGITRASFCNVYLEWIQHCARKRQEPSTTLDSDEDSPLVTLSFALCTLGRRALGTAAHNMAISLDSFLYGLHVLFKGDFRITARDEWVFADMDLLHKVVAPAIRMSLKLHQDQFTCPDEYEDPAVLYEAIQSFEKKVVICHEGDPAWRGAVLSNKEELLTLRHVVDEGADEYKVIMLHRSFLSFKVIKVNKECVRGLWAGQQQELIFLRNRNPERGSIQNNKQVLRNLINSSCDQPLGYPMYVSPLTTSYLGTHRQLKNIWGGPITLDRIRTWFWTKWVRMRKDCNARQHSGGNIEDVDGGGAPTTGGNNAPSGGSQESSAEQPRKGGAQHGVSSCEGTQRTGRRKGRSQSVQAHSALSQRPPMLSSSGPILESRQTFLQTSTSVHELAQRLSGSRLSLHASATSLHSQPPPVTTTGHLSVRERAEALIRSSLGSSTSSTLSFLFGKRSFSSALVISGLSAAEGGNTSDTQSSSSVNIVMGPSARAASQATRVRGWAGLTRTGWDGGTGSWPERGTCLAFPPFCLQNPIPFSMGLPE

SEQ ID NO: 12772 - protein, 286 aa, Artificial Sequence
  Description of Artificial Sequence: Synthetic coding sequence
MHVFIDEHGEIRSCYLKSGNQKEGPLQPLPSNNDCLSQAREMQVSSSSTTTSESQDPSSGDPAVSALQQQLLLMVARRTQSETPRHVSQDLEASSCSSTQGKFNREQFYKFIIFPGKWIKVWYDRLTLLALLDRTEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIGKIMNSHKDFFTSEKKKDKIISAISSVIFLKSW

SEQ ID NO: 12773 - protein, 2034 aa, Artificial Sequence
  Description of Artificial Sequence: Synthetic coding sequence
MGSQVLQILRQGVWASLTGGWFFDPHQSTFSNCFHLYVWIFLLIFPFLLYMVLPPSLMVAGVYCLVVAVIFATIKTVNYRLHAMFDQGEIVEKRSSTMGELEEEPAQGDSNPPRDPGVEMTVFRKVSSTPPVRCSSQHSVFGFNQVSELLPRMEDSGPLRDIKELVREQGSNNVIVTSADREMLKLSSQEKLIGDLPQTPPGAVPDPSLASTDSSEPSPLAGDGAPWSGSSMADTPMSPLLKGSLSQELSKSFLTLTQPDRALVRTSSRREQRRGAGGYQPLDRRGSGEPTPQKAGSSDSCFSGTDRETLSSFKSEKTNSTHLDSPPGGPAPEGSDTDPPSEAELPASPDAGVPSDDTLRSFDTVIGAGTPPGLAEPLLVVRPKDLALLRPSKRQPPLRRHSPPGRAPRRPLLEGGGFFEDEDTSEGSELSPASSLRSQRRYSTDSSSSTSCYSPESSRGAAGGPRKRRAPHGAEEGTAVPPKRPYGTQRTPSTASAKTHARVLSMDGAGGDVLRPPLAGCKAELEAQVGVEQAASEPVVLPAEARRGPAANQPGWRGELQEEGAVGGAAEETGRRDRSSSVRRTQAIRRRHNAGSNPTPPASVMGSPPSSLQEAQRGRAASHSRALTLPSALHFASSLLLTRAGANVHEACTFDDTSEGAVHYFYDESGVRRSYTFGLAGGGYENPVGQQGEQTANGAWDRHSHSSSFHSADVPEATGGLNLLQPRPVVLQGMQVRRVPLEIPEEQTLMEEAPPRAQHSYKYWLLPGRWTSVRYERLALLALLDRTRGVLENIFGVGLSSLVAFLGYLLLLKGFFTDIWVFQFCLVIASCQYSLLKSVQPDAASPMHGHNWVIAYSRPVYFCICCLLIWLLDALGSAQPFPPVSLYGLTLFSASFFFCARDVATVFTLCFPFVFLLGLLPQVNTCLMYLLEQIDMHGFGGTAATSPLTAVFSLSRSLLAAALLYGFCLGAIKTPWPEQHVPVLFSVFCGLLVALSYHLSRQSSDPTVLWSLIRSKLFPELEERSLETARAEPPDPLPDKMRQSVREVLHSDLVMCVVIAVLTFAISASTVFIALKSVLGFVLYALAGAVGFFTHYLLPQLRKQLPWFCLSQPVLKPLEYSQYEVRGAAQVMWFEKLYAGLQCVEKYLIYPAVVLNALTVDAHTVVSHPDKYCFYCRALLMTVAGLKLLRSAFCCPPQQYLTLAFTVLLFHFDYPRLSQGFLLDYFLMSLLCSKLWDLLYKLRFVLTYIAPWQITWGSAFHAFAQPFAVPHSAMLFVQALLSGLFSTPLNPLLGSAVFIMSYARPLKFWERDYNTKRVDHSNTRLVTQLDRNPGADDNNLNSIFYEHLTRSLQHTLCGDLVLGRWGNYGPGDCFVLASDYLNALVHLIEVGNGLVTFQLRGLEFRGTYCQQREVEAITEGVEEDEGCCCCEPGHLPRVLSFNAAFGQRWLAWEVTASKYVLEGYSISDNNAASMLQVFDLRKILITYYVKSIIYYVSRSPKLEVWLSHEGITAALRPVRVPGYADSDPTFSLSVDEDYDLRLSGLSLPSFCAVHLEWIQYCASRRSQPVDQDWNSPLVTLCFGLCVLGRRALGTASHSMSASLEPFLYGLHALFKGDFRITSPRDEWVFADMDLLHRVVAPGVRMALKLHQDHFTSPDEYEEPAALYDAIAANEERLVISHEGDPAWRSAILSNTPSLLALRHVLDDASDEYKIIMLNRRHLSFRVIKVNRECVRGLWAGQQQELVFLRNRNPERGSIQNAKQALRNMINSSCDQPLGYPIYVSPLTTSLAGSHPQLRALWGGPISLGAIAHWLLRTWERLHKGCGAGCNSGGNVDDSDCSGGGGLTSLSNNPPVAHPTPENTAGNGDQPLPPGPGWGPRSSLSGSGDGRPPPLLQWPPPRLPGPPPASPIPTEGPRTSRPPGPGLLSSEGPSGKWSLGGRKGLGGSDGEPASGSPKGGTPKSQAPLDLSLSLSLSLSPDVSTEASPPRASQDIPCLDSSAPESGTPMGALGDWPAPIEERESPAAQPLLEHQY

SEQ ID NO: 12774 - protein, 388 aa, Artificial Sequence
  Description of Artificial Sequence: Synthetic coding sequence
MVRDSMAAAFRPSNRVLLQALQILVYPGVGGSGSVSCRCPLGAKRYLLTDNVVKLKEFQQKKVAVACNLSGTKETYFRNLKKKLTQNKLILKGELITLLHLCESRDHVELAKNVIYRYHAENKNFTLGEYKFGPLFVRLCYELDLEESAVELMKDQHLRGFFSDSTSFNILMDMLFIKGKYKSALQVLIEMKNQDVKFTKDTYVLAFAICYKLNSPESFKICTTLREEALLKGEILSRRASCFAVALALNQNEMAKAVSIFSQIMNPESIACINLNIIIHIQSNMLENLIKTLKNAAEGNLSKFVKRHVFSEEVLAKVREKVKDVPALVAKFDEIYGTLHITGQVTTDSLDAVLCHTPRDRKSHTLLLNKRMVSRRTFQPLSQSLLAE

SEQ ID NO: 12775 - protein, 388 aa, Artificial Sequence; identical to SEQ ID NO: 12774
  Description of Artificial Sequence: Synthetic coding sequence

SEQ ID NO: 12776 - protein, 216 aa, Artificial Sequence
  Description of Artificial Sequence: Synthetic coding sequence
MWNWLKMSFTGALQVLIEMKNQDVKFTKDTYVLAFAICYKLNSPESFKICTTLREEALLKGEILSRRASCFAVALALNQNEMAKAVSIFSQIMNPESIACINLNIIIHIQSNMLENLIKTLKNAAEGNLSKFVKRHVFSEEVLAKVREKVKDVPALVAKFDEIYGTLHITGQVTTDSLDAVLCHTPRDRKSHTLLLNKRMVSRRTFQPLSQSLLAE

SEQ ID NO: 12777 - protein, 161 aa, Artificial Sequence
  Description of Artificial Sequence: Synthetic coding sequence
MVRDSMAAAFRPSNRVLLQALQILVYPGVGGSGSVSCRCPLGAKRYLLTDNVVKLKEFQQKKVAVACNLSGTKETYFRNLKKKLTQNKLILKGELITLLHLCESRDHVELAKNVIYRYHAENKNFTLGEYKFGPLFVRLCYELDLEESAVELMKDQVLCKY

SEQ ID NO: 12778 - protein, 689 aa, Artificial Sequence
  Description of Artificial Sequence: Synthetic coding sequence
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPCLMPEYFEPQIKDISEAALKERIELRKVKASVDMFDQLLQAGTTVSLETTNSLLDLLCYYGDQEPSTDYHFQQTGQSEALEEENDETSRRKAGHQFGVTWRAKNNAERIFSLMPEKNEHSYCTMIRGMVKHRAYEQALNLYTELLNNRLHADVYTFNALIEATVCAINEKFEEKWSKILELLRHMVAQKVKPNLQTFNTILKCLRRFHVFARSPALQVLREMKAIGIEPSLATYHHIIRLFDQPGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWKDSKEYGHTFRSDLREEILMLMARDKHPPELQVAFADCAADIKSAYESQPIRQTAQDWPATSLNCIAILFLRAGRTQEAWKMLGLFRKHNKIPRSELLNELMDSAKVSNSPSQAIEVVELASAFSLPICEGLTQRVMSDFAINQEQKEALSNLTALTSDSDTDSSSDSDSDTSEGK

SEQ ID NO: 12779 - protein, 208 aa, Artificial Sequence
  Description of Artificial Sequence: Synthetic coding sequence
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPEPLCLLKQQIVSWIYCVTMVTRSPQLITIFNKLDSQKHWKRKMMRHLGGKLVISLELHGEQKTTLRESFL

SEQ ID NO: 12780 - protein, 489 aa, Artificial Sequence
  Description of Artificial Sequence: Synthetic coding sequence
MAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTHKGEIPALPPCKFTGSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGSTPICEDIGRQMLCYNRRIPIPELEARIDAVNAETIREVCTKYIYNRSPAIAAVGPIKQLPDFKQIRSNMCWLRD

SEQ ID NO: 12781 - protein, 403 aa, Artificial Sequence
  Description of Artificial Sequence: Synthetic coding sequence
MAFKGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTHKGEIPALPPCKFTGSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGSTPICEDIGRQMLCYNRRIPIPELEARIDAVNAETIREVCTKYIYNRSPAIAAVGYNHRSELHEWKWNKLFSKRQTISYSYVNILLPQPQPQYV

SEQ ID NO: 12782 - protein, 214 aa, Artificial Sequence
  Description of Artificial Sequence: Synthetic coding sequence
MRPGGFLGAGQRLSRAMSRCVLEPRPPGKRWMVAGLGNPGLPGTRHSVGMAVLGQLARRLGVAESWTRDRHCAADLALAPLGDAQLVLLRPRRLMNANGRSVARAAELFGLTAEEVYLVHDELDKPLGRLALKLGGSARGHNGVRSCISCLNSNAMPRLRVGIGRPAHPEAVQAHVLGCFSPAEQELLPLLLDRATDLILDHIRERSQGPSLGP

SEQ ID NO: 12783 - protein, 214 aa, Artificial Sequence; identical to SEQ ID NO: 12782
  Description of Artificial Sequence: Synthetic coding sequence

SEQ ID NO: 12784 - protein, 1357 aa, Artificial Sequence
  Description of Artificial Sequence: Synthetic coding sequence
MQTLGSFFGSLPGFSSARNLVANAHSSARARPAADPTGAPAAEAAQPQAQVAAHPEQTAPWTEKELQPSEKQMVSGAKDLVCSKMSRAKDAVSSGVASVVDVAKGVVQGGLDTTRSALTGTKEVVSSGVTGAMDMAKGAVQGGLDTSKAVLTGTKDTVSTGLTGAVNVAKGTVQAGVDTTKTVLTGTKDTVTTGVMGAVNLAKGTVQTGVETSKAVLTGTKDAVSTGLTGAVNVARGSIQTGVDTSKTVLTGTKDTVCSGVTGAMNVAKGTIQTGVDTSKTVLTGTKDTVCSGVTGAMNVAKGTIQTGVDTSKTVLTGTKDTVCSGVTGAMNVAKGTIQTGVDTTKTVLTGTKNTVCSGVTGAVNLAKEAIQGGLDTTKSMVMGTKDTMSTGLTGAANVAKGAMQTGLNTTQNIATGTKDTVCSGVTGAMNLARGTIQTGVDTTKIVLTGTKDTVCSGVTGAANVAKGAVQGGLDTTKSVLTGTKDAVSTGLTGAVNVAKGTVQTGVDTTKTVLTGTKDTVCSGVTSAVNVAKGAVQGGLDTTKSVVIGTKDTMSTGLTGAANVAKGAVQTGVDTAKTVLTGTKDTVTTGLVGAVNVAKGTVQTGMDTTKTVLTGTKDTIYSGVTSAVNVAKGAVQTGLKTTQNIATGTKNTFGSGVTSAVNVAKGAAQTGVDTAKTVLTGTKDTVTTGLMGAVNVAKGTVQTSVDTTKTVLTGTKDTVCSGVTGAANVAKGAIQGGLDTTKSVLTGTKDAVSTGLTGAVKLAKGTVQTGMDTTKTVLTGTKDAVCSGVTGAANVAKGAVQMGVDTAKTVLTGTKDTVCSGVTGAANVAKGAVQTGLKTTQNIATGTKNTLGSGVTGAAKVAKGAVQGGLDTTKSVLTGTKDAVSTGLTGAVNLAKGTVQTGVDTSKTVLTGTKDTVCSGVTGAVNVAKGTVQTGVDTAKTVLSGAKDAVTTGVTGAVNVAKGTVQTGVDASKAVLMGTKDTVFSGVTGAMSMAKGAVQGGLDTTKTVLTGTKDAVSAGLMGSGNVATGATHTGLSTFQNWLPSTPATSWGGLTSSRTTDNGGEQTALSPQEAPFSGISTPPDVLSVGPEPAWEAAATTKGLATDVATFTQGAAPGREDTGLLATTHGPEEAPRLAMLQNELEGLGDIFHPMNAEEQAQLAASQPGPKVLSAEQGSYFVRLGDLGPSFRQRAFEHAVSHLQHGQFQARDTLAQLQDCFRLIEKAQQAPEGQPRLDQGSGASAEDAAVQEERDAGVLSRVCGLLRQLHTAYSGLVSSLQGLPAELQQPVGRARHSLCELYGIVASAGSVEELPAERLVQSREGVHQAWQGLEQLLEGLQHNPPLSWLVGPFALPAGGQ

SEQ ID NO: 12785 - protein, 259 aa, Artificial Sequence
  Description of Artificial Sequence: Synthetic coding sequence
MDAWVRFSAQSQARERLCRAAQYACSLLGHALQRHGASPELQKQIRQLESHLSLGRKLLRLGNSADALESAKRAVHLSDVVLRFCITVSHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 12786 - protein, 81 aa, Artificial Sequence
  Description of Artificial Sequence: Synthetic coding sequence
PGGGLPQLALKLRLQVLLLARVLRGHPPLLLDVVRNACDLFIPLDKLGLWRCGPGIVGLCGLVSSILSILTLIYPWLRLKP

SEQ ID NO: 12787 - protein, 245 aa, Artificial Sequence
  Description of Artificial Sequence: Synthetic coding sequence
MGKLRAAQYACSLLGHALQRHGASPELQKQIRQLESHLSLGRKLLRLGNSADALESAKRAVHLSDVVLRFCITVSHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 12788 - protein, 359 aa, Artificial Sequence
  Description of Artificial Sequence: Synthetic coding sequence
MAEHGAHFTAASVADDQPSIFEVVAQDSLMTAVRPALQHVVKVLAESNPTHYGFLWRWFDEIFTLLDLLLQQHYLSRTSASFSENFYGLKRIVMGDTHKSQRLASAGLPKQQLWKSIMFLVLLPYLKVKLEKLVSSLREEDEYSIHPPSSRWKRFYRAFLAAYPFVNMAWEGWFLVQQLRYILGKAQHHSPLLRLAGVQLGRLTVQDIQALEHKPAKASMMQQPARSVSEKINSALKKAVGGVALSLSTGLSVGVFFLQFLDWWYSSENQETIKSLTALPTPPPPVHLDYNSDSPLLPKMKTVCPLCRKTRVNDTVLATSGYVFCYRCVFHYVRSHQACPITGYPTEVQHLIKLYSPEN

SEQ ID NO: 12789 - protein, 324 aa, Artificial Sequence
  Description of Artificial Sequence: Synthetic coding sequence
MAEHGAHFTAASVADDQPSIFEVVAQDSLMTAVRPALQHVVKVLAESNPTHYGFLWRWFDEIFTLLDLLLQQHYLSRTSASFSENFYGLKRIVMGDTHKSQRLASAGLPKQQLWKSIMFLVLLPYLKVKLEKLVSSLREEDEYSIHPPSSRWKRFYRAFLAAYPFVNMAWEGWFLVQQLRYILGKAQHHSPLLRLAGVQLGRLTVQDIQALEHKPAKASMMQQPARSVSEKINSALKKAVGGVALSLSTGLSVGVFFLQFLDWWYSSENQETIKSLTALPTPPPPVHLDYNSDSPLLPKMKTVCPKKKKKKERKKKKERKKERR

SEQ ID NO: 12790 - protein, 195 aa, Artificial Sequence
  Description of Artificial Sequence: Synthetic coding sequence
MAPAASRLRAEAGLGALPRRALAQYLLFLRLYPVLTKAATSGILSALGNFLAQMIEKKRKKENSRSLDVGGPLRYAVYGFFFTGPLSHFFYFFMEHWIPPEVPLAGLRRLLLDRLVFAPAFLMLFFLIMNFLEGKDASAFAAKMRGGFWPALRMNWRVWTPLQFININYVPLKFRVLFANLAALFWYAYLASLGK

SEQ ID NO: 12791 - protein, 167 aa, Artificial Sequence
  Description of Artificial Sequence: Synthetic coding sequence
MPFTGERRLSLRRQDEGGLLAGAEDELAGVDATTVHQHQLRPSEVPGALRQPGSSVLVCLPGLLGEVTTAGRTSGALWTWVWGSHPPSESRTNPVRMSLTLNQARTTVSDQRAEEERGIWGRRAGVQAGPLQSQGHAAHLPHQAFPVPRGWLPGEGPHSDPAGSGAG

SEQ ID NO: 12792 - protein, 71 aa, Artificial Sequence
  Description of Artificial Sequence: Synthetic coding sequence
MAAPPQLRALLVVVNALLRKRRYHAALAVLKGFRNGAVYGAKIRAPHALVMTFLFRNGRSTCTCCHASCLP

SEQ ID NO: 12793 - protein, 212 aa, Artificial Sequence
  Description of Artificial Sequence: Synthetic coding sequence
MAAPPQLRALLVVVNALLRKRRYHAALAVLKGFRNGAVYGAKIRAPHALVMTFLFRNGSLQEKLWAILQATYIHSWNLARFVFTYKGLRALQSYIQGKTYPAHAFLAAFLGGILVFGENNNINSQINMYLLSRVLFALSRLAVEKGYIPEPRWDPFPLLTAVVWGLVLWLFEYHRSTLQPSLQSSMTYLYEDSNVWHDISDFLVYNKSRPSN

SEQ ID NO: 12794 - protein, 175 aa, Artificial Sequence
  Description of Artificial Sequence: Synthetic coding sequence
MIRCGLACERCRWILPLLLLSDHGQTSSLWWKCSQEGGGSGSYEEGCQSLMEYAWGRAAAAMLFCGFIILVICFILSFFALCGPQMLVFLRVIGGLLALAAVFQIISLVIYPVKYTQTFTLHANPAVTYIYNWAYGFGWAATIILIGCAFFFCCLPNYEDDLLGNAKPRYFYTSA

SEQ ID NO: 12795 - protein, 193 aa, Artificial Sequence
  Description of Artificial Sequence: Synthetic coding sequence
MIRCGLACERCRWILPLLLLSAIAFDIIALAGRGWLQSSDHGQTSSLWWKCSQEGGGSGSYEEGCQSLMEYAWGRAAAAMLFCGFIILVICFILSFFALCGPQMLVFLRVIGGLLALAAVFQIISLVIYPVKYTQTFTLHANPAVTYIYNWAYGFGWAATIILIGCAFFFCCLPNYEDDLLGNAKPRYFYTSA

SEQ ID NO: 12796 - protein, 557 aa, Artificial Sequence
  Description of Artificial Sequence: Synthetic coding sequence
MAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPAGYQITQQRLPIAVNGSLIYGVCAGKKQSQVIPKTVRIKQIQLEQDSGKSLHDNLRSQTLIDLNRAGVGLLEVVLEPDMSCGEEAATAVRELQLILQALGTSQANMAEGQLRVDANISVHHPGEPLGVRTEVKNLNSIRFLAKAIDYEIQRQINELENGGEILNETRSFHHKLGCTMSMRDKEGKQDYRFMPEPNLPPLVLYDATSLPAGADPQQVINIDQIRETLPELPSVTREKLVQQYGMLLEHSFTLLNEVGLLEFFQNVIKETRAEPKKVTSWVLNTFLGYLKQQNLAVSESPVTPSALAELLDLLDSRTISSSAAKQVFEELWKREGKTPGQIVSEKQLELMQDQGALEQLCHSVMEAHPQVVMDVKNRNPRAINKLIGLVRKATQSRADPVMIKEILEKKLSL

SEQ ID NO: 12797 - protein, 261 aa, Artificial Sequence
  Description of Artificial Sequence: Synthetic coding sequence
MHGIGPSGSFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 12798 - protein, 96 aa, Artificial Sequence
  Description of Artificial Sequence: Synthetic coding sequence
MRELAIEIGVRALLFGVFVFTEFLDPFQRVIQPEEIWLYKNPLVQSDNIPTRLMFIPLWVESSASFLHTFATDSTILLWPTQLAINPTLVCESQPH

SEQ ID NO: 12799 - protein, 271 aa, Artificial Sequence
  Description of Artificial Sequence: Synthetic coding sequence
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 12800 - protein, 267 aa, Artificial Sequence
  Description of Artificial Sequence: Synthetic coding sequence
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGIT

SEQ ID NO: 12801 - protein, 208 aa, Artificial Sequence
  Description of Artificial Sequence: Synthetic coding sequence
MRELAIEIGVRALLFGVFVFTEFLDPFQRVIQPEEIWLYKNPLVQSDNIPTRLMFAISFLTPLAVICVVKIIRRTDKTEIKEAFLVAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 12802 - protein, 233 aa, Artificial Sequence
  Description of Artificial Sequence: Synthetic coding sequence
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQVGCCVWQGPQSHLPSAANPRLCLGTSEP

SEQ ID NO: 12803 - protein, 151 aa, Artificial Sequence
  Description of Artificial Sequence: Synthetic coding sequence
MPASQSRARARDRNNVLNRAEFLSLNQPPKGGPEPRSSGRKASGPSAQPPPAGDGARERRQSQQLPEEDCMQLNPSFKGIAFNSLLAIDICMSKRLGVCAGRAASWASARSMVKLIGITGHGIPWIGGTILCLVKSSTLAGQEVLMNLLLD

SEQ ID NO: 12804 - protein, 271 aa, Artificial Sequence
  Description of Artificial Sequence: Synthetic coding sequence
MPASQSRARARDRNNVLNRAEFLSLNQPPKGGPEPRSSGRKASGPSAQPPPAGDGARERRQSQQLPEEDCMQLNPSFKGIAFNSLLAIDICMSKRLGVCAGRAASWASARSMVKLIGITGHGIPWIGGTILCLVKSSTLAGQEVLMNLLLALLLDIMTVAGVQKLIKRRGPYETSPSLLDYLTMDIYAFPAGHASRAAMVSKFFLSHLVLAVPLRVLLVLWALCVGLSRVMIGRHHVTDVLSGFVIGYLQFRLVELVWMPSSTCQMLISAW

SEQ ID NO: 12805 - protein, 285 aa, Artificial Sequence
  Description of Artificial Sequence: Synthetic coding sequence
MFDKTRLPYVALDVLCVLLASMPMAVLKLGQIYPFQRGFFCKDNSINYPYHDSTVTSTVLILVGVGLPISSIILGETLSVYCNLLHSNSFIRNNYIATIYKAIGTFLFGAAASQSLTDIAKYSIGRLRPHFLDVCDPDWSKINCSDGYIEYYICRGNAERVKEGRLSFYSGHSSFSMYCMLFVALYLQARMKGDWARLLRPTLQFGLVAVSIYVGLSRVSDYKHHWSDVLTGLIQGALVAILVAVYVSDFFKERTSFKERKEEDSHTTLHETPTTGNHYPSNHQP

SEQ ID NO: 12806 - protein, 284 aa, Artificial Sequence
  Description of Artificial Sequence: Synthetic coding sequence
MFDKTRLPYVALDVLCVLLAGLPFAILTSRHTPFQRGVFCNDESIKYPYKEDTIPYALLGGIIIPFSIIVIILGETLSVYCNLLHSNSFIRNNYIATIYKAIGTFLFGAAASQSLTDIAKYSIGRLRPHFLDVCDPDWSKINCSDGYIEYYICRGNAERVKEGRLSFYSGHSSFSMYCMLFVALYLQARMKGDWARLLRPTLQFGLVAVSIYVGLSRVSDYKHHWSDVLTGLIQGALVAILVAVYVSDFFKERTSFKERKEEDSHTTLHETPTTGNHYPSNHQP

SEQ ID NO: 12807 - protein, 311 aa, Artificial Sequence
  Description of Artificial Sequence: Synthetic coding sequence
MQNYKYDKAIVPESKNGGSPALNNNPRRSGSKRVLLICLDLFCLFMAGLPFLIIETSTIKPYHRGFYCNDESIKYPLKTGETINDAVLCAVGIVIAILAIITGEFYRIYYLKKSRSTIQNPYVAALYKQVGCFLFGCAISQSFTDIAKVSIGRLRPHFLSVCNPDFSQINCSEGYIQNYRCRGDDSKVQEARKSFFSGHASFSMYTMLYLVLYLQARFTWRGARLLRPLLQFTLIMMAFYTGLSRVSDHKHHPSDVLAGFAQGALVACCIVFFVSDLFKTKTTLSLPAPAIRKEILSPVDIIDRNNHHNMM

SEQ ID NO: 12808 - protein, 288 aa, Artificial Sequence
  Description of Artificial Sequence: Synthetic coding sequence
MQRRWVFVLLDVLCLLVASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 12809 - protein, 309 aa, Artificial Sequence
  Description of Artificial Sequence: Synthetic coding sequence
MGVARGPGSRGQHPPPRQQEVCAEGPRARLHPAPPGLGASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 12810 - protein, 232 aa, Artificial Sequence
  Description of Artificial Sequence: Synthetic coding sequence
MAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 12811 - protein, 236 aa, Artificial Sequence
  Description of Artificial Sequence: Synthetic coding sequence
MKRSGNPGAEVTNSSVAGPDCCGGLGNIDFRQADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 12812 - protein, 232 aa, Artificial Sequence
  Description of Artificial Sequence: Synthetic coding sequence
MKRSGNPGAEVTNSSVAGPDCCGGLGNIDFRQADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIIPAPAGAVGSEARQPHGPAPDGAGGPHLHSGSPIRRALHR

SEQ ID NO: 12813 - protein, 199 aa, Artificial Sequence
  Description of Artificial Sequence: Synthetic coding sequence
MTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 12814 - protein, 199 aa, Artificial Sequence; identical to SEQ ID NO: 12813
  Description of Artificial Sequence: Synthetic coding sequence

SEQ ID NO: 12815 - protein, 213 aa, Artificial Sequence
  Description of Artificial Sequence: Synthetic coding sequence
MKRSGNPGAEVTNSSVAGPDCCGGLGNIDFRQADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIILCPCGRYPFPQRGPRAMREA

SEQ ID NO: 12816 - protein, 211 aa, Artificial Sequence
  Description of Artificial Sequence: Synthetic coding sequence
MKRSGNPGAEADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIISPAPAGAVGSEARQPHGPAPDGAGGPHLHSGSPIRRALHR

SEQ ID NO: 12817 - protein, 227 aa, Artificial Sequence
  Description of Artificial Sequence: Synthetic coding sequence
MGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 12818 - protein, 556 aa, Artificial Sequence
  Description of Artificial Sequence: Synthetic coding sequence
MAVAAAAAAGPVFWRRLLGLLPGRPGLAALLGRLSDRLGRNRDRQRRRSPWLLLAPLLSPAVPQVTSPPCCLCPEGVHRFQWIRNLVPEFGVSSSHVRVLSSPAEFFELMKGQIRVAKRRVVMASLYLGTGPLEQELVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGANLSDSYFTNRQDRYVFLQDCAEIADFFTELVDAVGDVSLQLQGDDTVQVVDGMVHPYKGDRAEYCKAANKRVMDVINSARTRQQMLHAQTFHSNSLLTQEDAAAAGDRRPAPDTWIYPLIQMKPFEIQIDEIVTETLLTEAERGAKVYLTTGYFNLTQAYMDLVLGTRAEYQILLASPEVNGFFGAKGVAGAIPAAYVHIERQFFSEVCSLGQQERVQLQEYWRRGWTFHAKGLWLYLAGSSLPCLTLIGSPNFGYRSVHRDLEAQIAIVTENQALQQQLHQEQEQLYLRSGVVSSATFEQPSRQVKLWVKMVTPLIKNFF

SEQ ID NO: 12819 - protein, 421 aa, Artificial Sequence
  Description of Artificial Sequence: Synthetic coding sequence
MKVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGANLSDSYFTNRQDRYVFLQDCAEIADFFTELVDAVGDVSLQLQGDDTVQVVDGMVHPYKGDRAEYCKAANKRVMDVINSARTRQQMLHAQTFHSNSLLTQEDAAAAGDRRPAPDTWIYPLIQMKPFEIQIDEIVTETLLTEAERGAKVYLTTGYFNLTQAYMDLVLGTRAEYQILLASPEVNGFFGAKGVAGAIPAAYVHIERQFFSEVCSLGQQERVQLQEYWRRGWTFHAKGLWLYLAGSSLPCLTLIGSPNFGYRSVHRDLEAQIAIVTENQALQQQLHQEQEQLYLRSGVVSSATFEQPSRQVKLWVKMVTPLIKNFF

SEQ ID NO: 12820 - protein, 268 aa, Artificial Sequence
  Description of Artificial Sequence: Synthetic coding sequence
MKVDCLESTLEKSLQAKFPSNLKVSILLDFTRGSRGRKNSRTMLLPLLRRFPEQVRVSLFHTPHLRGLLRLLIPERFNETIGLQHIKVYLFDNSVILSGANLSDSYFTNRQDRYVFLQDCAEIADFFTELVDAVGDVSLQLQGDDTVQVVDGMVHPYKGDRAEYCKAANKRVMDVINSARTRQQMLHAQTFHSNSLLTQEDAAAAGDRRPAPDTWIYPLIQMKPFEIQIDEIVTETLLTEAERGAKVYLTTGYFNLTQAYMPGLGHSG

SEQ ID NO: 12821 - protein, 299 aa, Artificial Sequence
  Description of Artificial Sequence: Synthetic coding sequence
MPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKGSHPAPAQRPTGTAQKG

SEQ ID NO: 12822 - protein, 975 aa, Artificial Sequence
  Description of Artificial Sequence: Synthetic coding sequence
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQGNSNNIATVDISAGFVGLDTYVEIPAVLLTAFGTYAGPVLWASHLVHFLSSETRSGSALSHACFCYALICSIPVFTYIVLVTSLRYHLFIWSVFSPKLLYEGMHLLITAAVCVFFTAMDQTRLTQS

SEQ ID NO: 12823 - protein, 850 aa, Artificial Sequence
  Description of Artificial Sequence: Synthetic coding sequence
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQGNSNNIATVDISAGFVGLDTYVEIPAVLLTAFGTYAGPVLWASHLVHFLSSETRSGSALSHACFCYALICSIPVFTYIVLVTSLRYHLFIWSVFSPKLLYEGMHLLITAAVCVFFTAMDQTRLTQS

SEQ ID NO: 12824 - protein, 983 aa, Artificial Sequence
  Description of Artificial Sequence: Synthetic coding sequence
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQGNSNNIATVDISAGFVGLDTYVEIPAVLLTAFGTYAGPVLWASHLVHFLSSETRSGSALSHACFCYALICSIPVFTYIVLVTSLRYHLFIWSVFSPKLLYEGMHLLITAAVCVFFTAMDQTRLTQS

SEQ ID NO: 12825 - protein, 141 aa, Artificial Sequence
  Description of Artificial Sequence: Synthetic coding sequence
MHYWFGQAFFYFQGNSNNIATVDISAGFVGLDTYVEIPAVLLTAFGTYAGPVLWASHLVHFLSSETRSGSALSHACFCYALICSIPVFTYIVLVTSLRYHLFIWSVFSPKLLYEGMHLLITAAVCVFFTWIKPDSHSLRLS

SEQ ID NO: 12826 - protein, 299 aa, Artificial Sequence; identical to SEQ ID NO: 12821
  Description of Artificial Sequence: Synthetic coding sequence

SEQ ID NO: 12827 - protein, 341 aa, Artificial Sequence
  Description of Artificial Sequence: Synthetic coding sequence
MTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQFSPCSCSASHRHCAERLSWKSHCHLLGFLCSFIW

SEQ ID NO: 12828 - protein, 672 aa, Artificial Sequence
  Description of Artificial Sequence: Synthetic coding sequence
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 12829 - protein, 1089 aa, Artificial Sequence
  Description of Artificial Sequence: Synthetic coding sequence
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 12830 - protein, 672 aa, Artificial Sequence; identical to SEQ ID NO: 12828
  Description of Artificial Sequence: Synthetic coding sequence

SEQ ID NO: 12831 - protein, 1089 aa, Artificial Sequence; identical to SEQ ID NO: 12829
  Description of Artificial Sequence: Synthetic coding sequence

SEQ ID NO: 12832 - protein, 760 aa, Artificial Sequence
  Description of Artificial Sequence: Synthetic coding sequence
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLADKPTALQPRGAHLPPPQLWLPPQALLGRPVPQAVPWGAHLPLEAERGQAGLRELLARLAPPHGHSQPSALPGWHQLSWRMSCALWTLLCAPEHGRPCYHTLGLEVIGSEQMWGWPARLAALHHWHCLPWDPLPTCCGHHGGEHSNPRCPEHCPMPTLCTQVQRVRPPQQPQVEGWSPWGLPSGSALAVGVEGPCQDEPPSPRHPLAPSAEQHPASGGLKQSLTPVPSGPGPSLPEPHGVYLRMFPGEVAL

SEQ ID NO: 12833 - protein, 148 aa, Artificial Sequence
  Description of Artificial Sequence: Synthetic coding sequence
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLP

SEQ ID NO: 12834 - protein, 581 aa, Artificial Sequence
  Description of Artificial Sequence: Synthetic coding sequence
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAAGVKFRVLRHEAGRPLRLLMQINPLPYSRVVHTYRLPSCGCHPKHSWGALCRKLFLGELIYPWRQRGDKQD

SEQ ID NO: 12835 - protein, 251 aa, Artificial Sequence
  Description of Artificial Sequence: Synthetic coding sequence
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLR

SEQ ID NO: 12836 - protein, 581 aa, Artificial Sequence; identical to SEQ ID NO: 12834
  Description of Artificial Sequence: Synthetic coding sequence

SEQ ID NO: 12837 - protein, 314 aa, Artificial Sequence
  Description of Artificial Sequence: Synthetic coding sequence
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVAD

SEQ ID NO: 12838 - protein, 112 aa, Artificial Sequence
  Description of Artificial Sequence: Synthetic coding sequence
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHR

SEQ ID NO: 12839 - protein, 574 aa, Artificial Sequence
  Description of Artificial Sequence: Synthetic coding sequence
MWWALRPPGILPPGMVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAGSEPWRPEATGLCSSALGFSGLGSLNCRPGAKRGKVRGTRSQQGGHHPLA

SEQ ID NO: 12840 - protein, 299 aa, Artificial Sequence
  Description of Artificial Sequence: Synthetic coding sequence
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRCGPALVSAGLGACPLAPSPSPSAPR

SEQ ID NO: 12841 - protein, 159 aa, Artificial Sequence
  Description of Artificial Sequence: Synthetic coding sequence
QPFLNALGAALLCGLSDSLLCNVGGESPLTQLPPATIWTCTASPMSSTQWSPGWDPVLPPCTLCSTFYSTCLSLHTHRCTFRTRMALQWPPMPSIVPAGVGSLVYNVDSKTYNASVLPVRVEVDMVRWRCSWHSCGCSLGLLSPSCLQNACFQGLRVKG

SEQ ID NO: 12842 - protein, 555 aa, Artificial Sequence
  Description of Artificial Sequence: Synthetic coding sequence
MAAAGAAATHLEVARGKRAALFFAAVAIVLGLPLWWKTTETYRASLPYSQISGLNALQLRLMVPVTVVFTRESVPLDDQEKLPFTVVHEREIPLKYKMKIKCRFQKAYRRALDHEEEALSSGSVQEAEAMLDEPQEQAEGSLTVYVISEHSSLLPQDMMSYIGPKRTAVVRGIMHREAFNIIGRRIVQVAQAMSLTEDVLAAALADHLPEDKWSAEKRRPLKSSLGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 12843 - protein, 547 aa, Artificial Sequence
  Description of Artificial Sequence: Synthetic coding sequence
MPSEVARGKRAALFFAAVAIVLGLPLWWKTTETYRASLPYSQISGLNALQLRLMVPVTVVFTRESVPLDDQEKLPFTVVHEREIPLKYKMKIKCRFQKAYRRALDHEEEALSSGSVQEAEAMLDEPQEQAEGSLTVYVISEHSSLLPQDMMSYIGPKRTAVVRGIMHREAFNIIGRRIVQVAQAMSLTEDVLAAALADHLPEDKWSAEKRRPLKSSLGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 12844 - protein, 494 aa, Artificial Sequence [sequence omitted]

SEQ ID NO: 12845 - protein, 476 aa, Artificial Sequence
  Description of Artificial Sequence: Synthetic coding sequence
MAAAMPLALLVLLLLGPGGWCLAEPPRDSLREELVITPLPSGDVAATFQFRTRWDSELQREGDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 12846 - protein, 578 aa, Artificial Sequence
  Description of Artificial Sequence: Synthetic coding sequence
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 12847 - protein, 384 aa, Artificial Sequence
  Description of Artificial Sequence: Synthetic coding sequence
MAAAMPLALLVLLLLGPGGWCLAEPPRDSLREELVITPLPSGDVAATFQFRTRWDSELQREGDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 12848 - protein, 511 aa, Artificial Sequence
  Description of Artificial Sequence: Synthetic coding sequence
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENGYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 12849 - protein, 423 aa, Artificial Sequence
  Description of Artificial Sequence: Synthetic coding sequence
MWINLGRSSVMSSQGSSAPLSTSSTPPTQSLPLPPSNPWVWPMAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 12850 - protein, 522 aa, Artificial Sequence
  Description of Artificial Sequence: Synthetic coding sequence
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 12851 - protein, 316 aa, Artificial Sequence
  Description of Artificial Sequence: Synthetic coding sequence
MFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 12852 - protein, 114 aa, Artificial Sequence
  Description of Artificial Sequence: Synthetic coding sequence
MLSGARCRLASALRGTRAPPSAVARRCLHASGSRPLADRGKKTEEPPRDFDPALLEFLVCPLSKKPLRYEASTNELINEELGIAYPIIDGIPNMIPQAARMTRQSKKQEEVEQR

SEQ ID NO: 12853 - protein, 71 aa, Artificial Sequence
  Description of Artificial Sequence: Synthetic coding sequence
MFLSLPTLTVLIPLVSLAGLFYSASVEENFPQGCTSTASLCFYSLLLPITIPVYVFFHLWTWMGIKLFRHN

SEQ ID NO: 12854 - protein, 1343 aa, Artificial Sequence
  Description of Artificial Sequence: Synthetic coding sequence
MIIKEYRIPLPMTVEEYRIAQLYMIQKKSRNETYGEGSGVEILENRPYTDGPGGSGQYTHKVYHVGMHIPSWFRSILPKAALRVVEESWNAYPYTRTRFTCPFVEKFSIDIETFYKTDAGENPDVFNLSPVEKNQLTIDFIDIVKDPVPHNEYKTEEDPKLFQSTKTQRGPLSENWIEEYKKQVFPIMCAYKLCKVEFRYWGMQSKIERFIHDTGLRRVMVRAHRQAWCWQDEWYGLSMENIRELEKEAQLMLSRKMAQFNEDGEEATELVKHEAVSDQTSGEPPEPSSSNGEPLVGRGLKKQWSTSSKSSRSSKRGASPSRHSISEWRMQSIARDSDESSDDEFFDAHEDLSDTEEMFPKDITKWSSNDLMDKIESPEPEDTQDGLYRQGAPEFRVASSVEQLNIIEDEVSQPLAAPPSKIHVLLLVLHGGTILDTGAGDPSSKKGDANTIANVFDTVMRVHYPSALGRLAIRLVPCPPVCSDAFALVSNLSPYSHDEGCLSSSQDHIPLAALPLLATSSPQYQEAVATVIQRANLAYGDFIKSQEGMTFNGQVCLIGDCVGGILAFDALCYSNQPVSESQSSSRRGSVVSMQDNDLLSPGILMNAAHCCGGGGGGGGGGGSSGGGGSSGGSSLESSRHLSRSNVDIPRSNGTEDPKRQLPRKRSDSSTYELDTIQQHQAFLSSLHASVLRTEPCSRHSSSSTMLDGTGALGRFDFEITDLFLFGCPLGLVLALRKTVIPALDVFQLRPACQQVYNLFHPADPSASRLEPLLERRFHALPPFSVPRYQRYPLGDGCSTLLVETVQRNPELVLEGGPLAPLPHGDGFLETSMPVPAPTWQDGPRPGCAESDVLQTHNAAFQEHGAPSSPGTAPASRGFRRASEISIASQVSGMAESYTASSIAQIAAKWWGQKRIDYALYCPDALTAFPTVALPHLFHASYWESTDVVSFLLRQVMRHDNSSILELDGKEVSVFTPSKPREKWQRKRTHVKLRNVTANHRINDALANEDGPQVLTGRFMYGPLDMVTLTGEKVDVHIMTQPPSGEWLYLDTLVTNNSGRVSYTIPESHRLGVGVYPIKMVVRGDHTFADSYITVLPKGTEFVVFSIDGSFAASVSIMGSDPKVRAGAVDVVRHWQDLGYLIIYVTGRPDMQKQRVVAWLAQHNFPHGVVSFCDGLVHDPLRHKANFLKLLISELHLRVHAAYGSTKDVAVYSAISLSPMQIYIVGRPTKKLQQQCQFITDGYAAHLAQLKYSHRARPARNTATRMALRKGSFGLPGQGDFLRSRNHLLRTISAQPSGPSHRHERTQSQADGEQRGQRSMSVAAGCWGRAMTGRLEPGAAAGPK

SEQ ID NO: 12855 - protein, 1349 aa, Artificial Sequence
  Description of Artificial Sequence: Synthetic coding sequence
MIIKEYRIPLPMTVEEYRIAQLYMIQKKSRNETYGEGSGVEILENRPYTDGPGGSGQYTHKVYHVGMHIPSWFRSILPKAALRVVEESWNAYPYTRTRFTCPFVEKFSIDIETFYKTDAGENPDVFNLSPVEKNQLTIDFIDIVKDPVPHNEYKTEEDPKLFQSTKTQRGPLSENWIEEYKKQVFPIMCAYKLCKVEFRYWGMQSKIERFIHDTGLRRVMVRAHRQAWCWQDEWYGLSMENIRELEKEAQLMLSRKMAQFNEDGEEATELVKHEAVSDQTSGEPPEPSSSNGEPLVGRGLKKQWSTSSKSSRSSKRGASPSRHSISEWRMQSIARDSDESSDDEFFDAHEDLSDTEEMFPKDITKWSSNDLMDKIESPEPEDTQDGLYRQGAPEFRVASSVEQLNIIEDEVSQPLAAPPSKIHVLLLVLHGGTILDTGAGDPSSKKGDANTIANVFDTVMRVHYPSALGRLAIRLVPCPPVCSDAFALVSNLSPYSHDEGCLSSSQDHIPLAALPLLATSSPQYQEAVATVIQRANLAYGDFIKSQEGMTFNGQVCLIGDCVGGILAFDALCYSNQPVSESQSSSRRGSVVSMQDNDLLSPGILMNAAHCCGGGGGGGGGGGSSGGGGSSGGSSLESSRHLSRSNVDIPRSNGTEDPKRQLPRKRSDSSTYELDTIQQHQAFLSSLHASVLRTEPCSRHSSSSTMLDGTGALGRFDFEITDLFLFGCPLGLVLALRKTVIPALDVFQLRPACQQVYNLFHPADPSASRLEPLLERRFHALPPFSVPRYQRYPLGDGCSTLLADVLQTHNAAFQEHGAPSSPGTAPASRGFRRASEISIASQVSGMAESYTASSIAQKAPDALSHTPSVRRLSLLALPAPSPTTPGPHPPARKASPGLERAPGLPELDIGEVAAKWWGQKRIDYALYCPDALTAFPTVALPHLFHASYWESTDVVSFLLRQVMRHDNSSILELDGKEVSVFTPSKPREKWQRKRTHVKLRNVTANHRINDALANEDGPQVLTGRFMYGPLDMVTLTGEKVDVHIMTQPPSGEWLYLDTLVTNNSGRVSYTIPESHRLGVGVYPIKMVVRGDHTFADSYITVLPKGTEFVVFSIDGSFAASVSIMGSDPKVRAGAVDVVRHWQDLGYLIIYVTGRPDMQKQRVVAWLAQHNFPHGVVSFCDGLVHDPLRHKANFLKLLISELHLRVHAAYGSTKDVAVYSAISLSPMQIYIVGRPTKKLQQQCQFITDGYAAHLAQLKYSHRARPARNTATRMALRKGSFGLPGQGDFLRSRNHLLRTISAQPSGPSHRHERTQSQADGEQRGQRSMSVAAGCWGRAMTGRLEPGAAAGPK

SEQ ID NO: 12856 - protein, 1070 aa, Artificial Sequence
  Description of Artificial Sequence: Synthetic coding sequence
MIIKEYRIPLPMTVEEYRIAQLYMIQKKSRNETYGEGSGVEILENRPFWRMQSIARDSDESSDDEFFDAHEDLSDTEEMFPKDITKWSSNDLMDKIESPEPEDTQDGLYRQGAPEFRVASSVEQLNIIEDEVSQPLAAPPSKIHVLLLVLHGGTILDTGAGDPSSKKGDANTIANVFDTVMRVHYPSALGRLAIRLVPCPPVCSDAFALVSNLSPYSHDEGCLSSSQDHIPLAALPLLATSSPQYQEAVATVIQRANLAYGDFIKSQEGMTFNGQVCLIGDCVGGILAFDALCYSNQPVSESQSSSRRGSVVSMQDNDLLSPGILMNAAHCCGGGGGGGGGGGSSGGGGSSGGSSLESSRHLSRSNVDIPRSNGTEDPKRQLPRKRSDSSTYELDTIQQHQAFLSSLHASVLRTEPCSRHSSSSTMLDGTGALGRFDFEITDLFLFGCPLGLVLALRKTVIPALDVFQLRPACQQVYNLFHPADPSASRLEPLLERRFHALPPFSVPRYQRYPLGDGCSTLLADVLQTHNAAFQEHGAPSSPGTAPASRGFRRASEISIASQVSGMAESYTASSIAQKAPDALSHTPSVRRLSLLALPAPSPTTPGPHPPARKASPGLERAPGLPELDIGEVAAKWWGQKRIDYALYCPDALTAFPTVALPHLFHASYWESTDVVSFLLRQVMRHDNSSILELDGKEVSVFTPSKPREKWQRKRTHVKLRNVTANHRINDALANEDGPQVLTGRFMYGPLDMVTLTGEKVDVHIMTQPPSGEWLYLDTLVTNNSGRVSYTIPESHRLGVGVYPIKMVVRGDHTFADSYITVLPKGTEFVVFSIDGSFAASVSIMGSDPKVRAGAVDVVRHWQDLGYLIIYVTGRPDMQKQRVVAWLAQHNFPHGVVSFCDGLVHDPLRHKANFLKLLISELHLRVHAAYGSTKDVAVYSAISLSPMQIYIVGRPTKKLQQQCQFITDGYAAHLAQLKYSHRARPARNTATRMALRKGSFGLPGQGDFLRSRNHLLRTISAQPSGPSHRHERTQSQADGEQRGQRSMSVAAGCWGRAMTGRLEPGAAAGPK

SEQ ID NO: 12857 - protein, 15 aa, Artificial Sequence
  Description of Artificial Sequence: Synthetic coding sequence
MIIKEYRIPLPMTVE

SEQ ID NO: 12858 - protein, 41 aa, Artificial Sequence
  Description of Artificial Sequence: Synthetic coding sequence
MIIKEYRIPLPMTVEEYRIAQLYMIQKKSRNETYGEGSGVE

SEQ ID NO: 12859 - protein, 1349 aa, Artificial Sequence; identical to SEQ ID NO: 12855
  Description of Artificial Sequence: Synthetic coding sequence

SEQ ID NO: 12860 - protein, 416 aa, Artificial Sequence
  Description of Artificial Sequence: Synthetic coding sequence
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFLNEGQKLHVGEESKKNFLEKLKRDVEFLAQLKIMDYSLLVGIHDVDRAEQEEMEVEERAEDEECENDGVGGNLLCSYGTPPDSPGNLLSFPRFFGPGEFDPSVDVYAMKSHESSPKKEVYFMAIIDILTPYDTKKKAAHAAKTVKHGAGAEISTVNPEQYSKRFNEFMSNILT

SEQ ID NO: 12861 - protein, 277 aa, Artificial Sequence
  Description of Artificial Sequence: Synthetic coding sequence
MSSNCTSTTAVAVAPLSASKTKTKKKHFVCQKVKLFRASEPILSVLMWGVNHTINELSNVPVPVMLMPDDFKAYSKIKVDNHLFNKENLPSRFKFKEYCPMVFRNLRERFGIDDQDYQNSVTRSAPINSDSQGRCGTRFLTTYDRRFVIKTVSSEDVAEMHNILKKYHQFIVECHGNTLLPQFLGMYRLTVDGVETYMVVTRNVFSHRLTVHRKYDLKGSTVAREASDKEKAKDLPTFKDNDFLNEGQKLHVGEESKKNFLEKLKRDVEEILVLSPG

SEQ ID NO: 12862 - protein, 609 aa, Artificial Sequence
  Description of Artificial Sequence: Synthetic coding sequence
MWRLPGARAALRVIRTAVEKLSRAEAGSQTAAGAMERAVVRCVPSEPKLSLSFALADGSHKNMQRDQSEPLGRVLSRIATNALKGHAKAAAAKKSRKSRPNASGGAACSGPGPEPAVFCEPVVKLYYREEAVAEDVLNVDAWQDGAVLQIGDVKYKVERNPPAFTELQLPRYIMAGFPVCPKLSLEFGDPASSLFRWYKEAKPGAAEPEVGVPSSLSPSSPSSSWTETDVEERVYTPSNADIGLRLKLHCTPGDGQRFGHSRELESVCVVEAGPGTCTFDHRHLYTKKVTEDALIRTVSYNILADTYAQTEFSRTVLYPYCAPYALELDYRQNLIQKELTGYNADVICLQEVDRAVFSDSLVPALEAFGLEGVFRIKQHEGLATFYRKSKFSLLSQHDISFYEALESDPLHKELLEKLVLYPSAQEKVLQRSSVLQVSVLQSTKDSSKRICVANTHLYWHPKGGYIRLIQMAVALAHIRHVSCDLYPGIPVIFCGDFNSTPSTGMYHFVINGSIPEDHEDWASNGEEERCNMSLTHFFKLKSACGEPAYTNYVGGFHGCLDYIFIDLNALEVEQVIPLPSHEEVTTHQALPSVSHPSDHIALVCDLKWK

SEQ ID NO: 12863 - protein, 472 aa, Artificial Sequence
  Description of Artificial Sequence: Synthetic coding sequence
MWRLPGARAALRVIRTAVEKLSRAEAGSQTAAGAMERAVVRCVPSEPKLSLSFALADGSHKNMQRDQSEPLGRVLSRIATNALKGHAKAAAAKKSRKSRPNASGGAACSGPGPEPAVFCEPVVKLYYREEAVAEDVLNVDAWQDGAVLQIGDVKYKVERNPPAFTELQLPRYIMAGFPVCPKLSLEFGDPASSLFRWYKEAKPGAAEPEVGVPSSLSPSSPSSSWTETDVEERVYTPSNADIGLRLKLHCTPGDGQRFGHSRELESVCVVEAGPGTCTFDHRHLYTKKVTEDALIRTVSYNILADTYAQTEFSRTVLYPYCAPYALELDYRQNLIQKELTGYNADVICLQEVDRAVFSDSLVPALEAFGLEGVFRIKQHEGLATFYRKSKFSLLSQHDISFYEALESDPLHKELLEKLVLYPSAQEKVLQRSSVLQVSVLQSTKDSSKRICVANTHLYWHPKGRFYLVSQVT

SEQ ID NO: 12864 - protein, 941 aa, Artificial Sequence
  Description of Artificial Sequence: Synthetic coding sequence
MGQACGHSILCRSQQYPAARPAEPRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 12865 - protein, 685 aa, Artificial Sequence
  Description of Artificial Sequence: Synthetic coding sequence
MVLVLHHILIAVVQFLRRGQQVFLKPDEPPPPPQPCADSLQDALLSLGSVIDISGLQRAVKEALSAVLPRVETVYTYLLDGESQLVCEDPPHELPQEGKVRFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 12866 - protein, 950 aa, Artificial Sequence
  Description of Artificial Sequence: Synthetic coding sequence
MSYILKMPGTCLPGEGTTYELPPSSLHPSSAPVTSGGTCPALLTEAGWEAPIMAFTEAASAVGPSWTHSRASVSSTVKTERRRRVLQACGMVRRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKA

SEQ ID NO: 12867 - protein, 932 aa, Artificial Sequence
  Description of Artificial Sequence: Synthetic coding sequence
MKKQRIQEGKSLAHRRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 12868 - protein, 934 aa, Artificial Sequence
  Description of Artificial Sequence: Synthetic coding sequence
MVLVLHHILIAVVQFLRRGQQVFLKPDEPPPPPQPCADSLQDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFSRKDYQRMLDLMRDIILATDLAHHLRIFKDLQKMAEVGYDRNNKQHHRLLLCLLMTSCDLSDQTKGWKTTRKIAELIYKEFFSQGDLEKAMGNRPMEMMDREKAYIPELQISFMEHIAMPIYKLLQDLFPKAAELYERVASNREHWTKVSHKFTIRGLPSNNSLDFLDEEYEVPDLDGTRAPINGCCSLDAE

SEQ ID NO: 12869 - protein, 1141 aa, Artificial Sequence
  Description of Artificial Sequence: Synthetic coding sequence
MAVPGDAARVRDKPVHSGVSQAPTAGRDCHHRADPASPRDSGCRGCWGDLVLQPLRSSRKLSSALCAGSLSFLLALLVRLVRGEVGCDLEQCKEAAAAEEEEAAPGAEGGVFPGPRGGAPGGGARLSPWLQPSALLFSLLCAFFWMGLYLLRAGVRLPLAVALLAACCGGEALVQIGLGVGEDHLLSLPAAGVVLSCLAAATWLVLRLRLGVLMIALTSAVRTVSLISLERFKVAWRPYLAYLAGVLGILLARYVEQILPQSAEAAPREHLGSQLIAGTKEDIPVFKRRRRSSSVVSAEMSGCSSKSHRRTSLPCIPREQLMGHSEWDHKRGPRGSQSSGTSITVDIAVMGEAHGLITDLLADPSLPPNVCTSLRAVSNLLSTQLTFQAIHKPRVNPVTSLSENYTCSDSEESSEKDKLAIPKRLRRSLPPGLLRRVSSTWTTTTSATGLPTLEPAPVRRDRSTSIKLQEAPSSSPDSWNNPVMMTLTKSRSFTSSYAISAANHVKAKKQSRPGALAKISPLSSPCSSPLQGTPASSLVSKISAVQFPESADTTAKQSLGSHRALTYTQSAPDLSPQILTPPVICSSCGRPYSQGNPADEPLERSGVATRTPSRTDDTAQVTSDYETNNNSDSSDIVQNEDETECLREPLRKASACSTYAPETMMFLDKPILAPEPLVMDNLDSIMEQLNTWNFPIFDLVENIGRKCGRILSQVSYRLFEDMGLFEAFKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMWKKVIEEEQRLAGIENQSLDQTPQSHSSEQIQAIKEEEEEKGKPRGEEIPTQKPDQ

SEQ ID NO: 12870 - protein, 889 aa, Artificial Sequence
  Description of Artificial Sequence: Synthetic coding sequence
MAERGRLGLPGAPGALNTPVPMNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 12871 - protein, 893 aa, Artificial Sequence
  Description of Artificial Sequence: Synthetic coding sequence
MAERGRLGLPGAPGALNTPVPMNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQVQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 12872 - protein, 904 aa, Artificial Sequence
  Description of Artificial Sequence: Synthetic coding sequence
MAERGRLGLPGAPGALNTPVPMNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQVQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKRKKHFHFDFTLSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 12873 - protein, 255 aa, Artificial Sequence
  Description of Artificial Sequence: Synthetic coding sequence
MAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCSIPPLLSAGDFVLLGS

SEQ ID NO: 12874 - protein, 289 aa, Artificial Sequence
  Description of Artificial Sequence: Synthetic coding sequence
MAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCRALQFPPEGWLRLSLNNGSITHLVIRPNGRVALRTLGDTGFMPPDKITRS

SEQ ID NO: 12875 - protein, 805 aa, Artificial Sequence
  Description of Artificial Sequence: Synthetic coding sequence
MAASGVPRGCDILIVYSPDAEEWCQYLQTLFLSSRQVRSQKILTHRLGPEASFSAEDLSLFLSTRCVVVLLSAELVQHFHKPALLPLLQRAFHPPHRVVRLLCGVRDSEEFLDFFPDWAHWQELTCDDEPETYVAAVKKAISEDSGCDSVTDTEPEDEKVVSYSKQQNLPTVTSPGNLMVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 12876 - protein, 404 aa, Artificial Sequence
  Description of Artificial Sequence: Synthetic coding sequence
MRFFTSVACYGSCLFASELLIRCKDWLKGRPALFTALLACVLYLCEWTGAKHVPGSSYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 12877 - protein, 627 aa, Artificial Sequence
  Description of Artificial Sequence: Synthetic coding sequence
MVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 12878 - protein, 263 aa, Artificial Sequence
  Description of Artificial Sequence: Synthetic coding sequence
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGTTPLMGQAGTPGA

SEQ ID NO: 12879 - protein, 234 aa, Artificial Sequence
  Description of Artificial Sequence: Synthetic coding sequence
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRSVASLLGPLRRRGGRYTKSNFVAFLPKRKQDVENQLKM

SEQ ID NO: 12880 - protein, 241 aa, Artificial Sequence
  Description of Artificial Sequence: Synthetic coding sequence
MLLAWVQAFLVSNMLLAEAYGSGGCFWDNGHLYREDQTSPAPGLRCLNWLDAQSGLASAPVSGAGNHSYCRNPGEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGTTPLMGQAGTPGA

SEQ ID NO: 12881 - protein, 173 aa, Artificial Sequence
  Description of Artificial Sequence: Synthetic coding sequence
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGGRI

SEQ ID NO: 12882 - protein, 184 aa, Artificial Sequence
  Description of Artificial Sequence: Synthetic coding sequence
MLLAWVQAFLVSNMLLAEAYGSGETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGTTPLMGQAGTPGA

SEQ ID NO: 12883 - protein, 845 aa, Artificial Sequence
  Description of Artificial Sequence: Synthetic coding sequence
QFVQPEERRQGSLLGPGLPSHALGTLAKVAGRQDAAPPGGSAASEEREEGPSVEALAVSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYGSRQLQLAVPGAYEKPQLLPLQPPTEPGLPPTFTFHVNPVLSSRLHVELMELLAAVQSGPSAELEAQTSKLGEGGILLSSLPLGQEEQCSVALGEGQEVALSMKVEMSSGDLDLRLGFDLSDGEQEFLDRRKQVVSKALQQVLGLSEALDSGQVPVVAVLGSGGGTRAMSSLYGSLAGLQELGLLDTVTYLSGVSGSTWCISTLYRDPAWSQVALQGPIERAQVHVCSSKMGALSTERLQYYTQELGVRERSGHSVSLIDLWGLLVEYLLYQEENPAKLSDQQEAVRQGQNPYPIYTSVNVRTNLSGEDFAEWCEFTPYEVGFPKYGAYVPTELFGSELFMGRLLQLQPEPRICYLQGMWGSAFATSLDEIFLKTAGSGLSFLEWYRGSVNITDDCQKPQLHNPSRLRTRLLTPQGPFSQAVLDIFTSRFTSAQSFNFTRGLCLHKDYVAGREFVAWKDTHPDAFPNQLTPMRDCLYLVDGGFAINSPFPLALLPQRAVDLILSFDYSLEAPFEVLKMTEKYCLDRGIPFPSIEVGPEDMEEARECYLFAKAEDPRSPIVLHFPLVNRTFRTHLAPGVERQTAEEKAFGDFVINRPDTPYGMMNFTYEPQDFYRLVALSRYNVLNNVETLKCALQLALDRHQARERAGA

SEQ ID NO: 12884 - protein, 454 aa, Artificial Sequence
  Description of Artificial Sequence: Synthetic coding sequence
MLWALWPRWLADKMLPLLGAVLLQKREKRGPLWRHWRRETYPYYDLQVKVLRATNIRGTDLLSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYGSRQLQLAVPGAYEKPQLLPLQPPTEPGLPPTFTFHVNPVLSSRLHVELMELLAAVQSGPSAELEAQTSKLGEGGILLSSLPLGQEEQCSVALGEGQEVALSMKVEMSSGDLDLRLGFDLSDGEQEFLDRRKQVVSKALQQVLGLSEALDSGQVPVVAVLGSGGGTRAMSSLYGSLAGLQELGLLDTVTYLSGVSGSTWCISTLYRDPAWSQVALQGPIERAQVHVCSSKVGDVRVSPCQLPRLHSSNLDHSLW

SEQ ID NO: 12885 - protein, 849 aa, Artificial Sequence
  Description of Artificial Sequence: Synthetic coding sequence
MLWALWPRWLADKMLPLLGAVLLQKREKRGPLWRHWRRETYPYYDLQVKVLRATNIRGTDLLSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYGSRQLQLAVPGAYEKPQLLPLQPPTEPGLPPTFTFHVNPVLSSRLHVELMELLAAVQSGPSAELEAQTSKLGEGGILLSSLPLGQEEQCSVALGEGQEVALSMKVEMSSGDLDLRLGFDLSDGEQEFLDRRKQVVSKALQQVLGLSEALDSGQVPVVAVLGSGGGTRAMSSLYGSLAGLQELGLLDTVTYLSGVSGSTWCISTLYRDPAWSQVALQGPIERAQVHVCSSKMGALSTERLQYYTQELGVRERSGHSVSLIDLWGLLVEYLLYQEENPAKLSDQQEAVRQGQNPYPIYTSVNVRTNLSGEDFAEWCEFTPYEVGFPKYGAYVPTELFGSELFMGRLLQLQPEPRICYLQGMWGSAFATSLDEIFLKTAGSGLSFLEWYRGSVNITDDCQKPQLHNPSRLRTRLLTPQGPFSQAVLDIFTSRFTSAQSFNFTRGLCLHKDYVAGREFVAWKDTHPDAFPNQLTPMRDCLYLVDGGFAINSPFPLALLPQRAVDLILSFDYSLEAPFEVLKMTEKYCLDRGIPFPSIEVGPEDMEEARECYLFAKAEDPRSPIVLHFPLVNRTFRTHLAPGVERQTAEEKAFGDFVINRPDTPYGMMNFTYEPQDFYRLVALSRYNVLNNVETLKCALQLALDRHQARERAGA

SEQ ID NO: 12886 - protein, 851 aa, Artificial Sequence
  Description of Artificial Sequence: Synthetic coding sequence
MLWALWPRWLADKMLPLLGAVLLQKREKRGPLWRHWRRETYPYYDLQVKVLRATNIRGTDLLSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYGSRQLQLAVPGAYEKPQLLPLQPPTEPGLPPTFTFHVNPVLSSRLHVELMELLAAVQSGPSAELEAQTSKLGEGGILLSSLPLGQEEQCSVALGEGQEVALSMKVEMSSGDLDLRLGFDLSDGEQEFLDRRKQVVSKALQQVLGLSEALDSGQTQVPVVAVLGSGGGTRAMSSLYGSLAGLQELGLLDTVTYLSGVSGSTWCISTLYRDPAWSQVALQGPIERAQVHVCSSKMGALSTERLQYYTQELGVRERSGHSVSLIDLWGLLVEYLLYQEENPAKLSDQQEAVRQGQNPYPIYTSVNVRTNLSGEDFAEWCEFTPYEVGFPKYGAYVPTELFGSELFMGRLLQLQPEPRICYLQGMWGSAFATSLDEIFLKTAGSGLSFLEWYRGSVNITDDCQKPQLHNPSRLRTRLLTPQGPFSQAVLDIFTSRFTSAQSFNFTRGLCLHKDYVAGREFVAWKDTHPDAFPNQLTPMRDCLYLVDGGFAINSPFPLALLPQRAVDLILSFDYSLEAPFEVLKMTEKYCLDRGIPFPSIEVGPEDMEEARECYLFAKAEDPRSPIVLHFPLVNRTFRTHLAPGVERQTAEEKAFGDFVINRPDTPYGMMNFTYEPQDFYRLVALSRYNVLNNVETLKCALQLALDRHQARERAGA

SEQ ID NO: 12887 - protein, 865 aa, Artificial Sequence
  Description of Artificial Sequence: Synthetic coding sequence
MLWALWPRWLADKMLPLLGAVLLQKREKRGPLWRHWRRETYPYYDLQVKVLRATNIRGTDLLSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYGSRQLQLAVPGAYEKPQLLPLQPPTEPGLPPTFTFHVNPVLSSRLHVELMELLAAVQSGPSAELEAQTSKLGEGGILLSSLPLGQEEQCSVALGEGQEVALSMKVEMSSGDLDLRLGFDLSDGEQEFLDRRKQVVSKALQQVLGLSEALDSGQVPVVAVLGSGGGTRAMSSLYGSLAGLQELGLLDTVTYLSGVSGSTWCISTLYRDPAWSQVALQGPIERAQVHVCSSKMGALSTERLQYYTQELGVRERSGHSVSLIDLWGLLVEYLLYQEENPAKLSDQQEAVRQGQNPYPIYTSVNVRTNLSGEDFAEWCEFTPYEVGFPKYGAYVPTELFGSELFMGRLLQLQPEPRICYLQGMWGSAFATSLDEIFLKTAGSGLSFLEWYRGSVNITDDCQKPQLHNPSRLRTRLLTPQGPFSQAVLDIFTSRFTSAQSFNFTRGLCLHKDYVAGREFVAWKDTHPDAFPNQLTPMRDCLYLVDGGFAINSPFPLALLPQRAVDLILSFDYSLEAPFEVLKMTEKYCLDRGIPFPSIEVGPEDMEEARECYLFAKAEDPRSPIVLHFPLVNRTFRTHLAPGVERQTAEEKAFGDFVINRPDTPYGMMNFTYEPQDFYRLVALSRYNVLNNVETLKCAHPRHRRTSEGPSPQTHTEQGLRALRSQLSSLH

SEQ ID NO: 12888 - protein, 589 aa, Artificial Sequence
  Description of Artificial Sequence: Synthetic coding sequence
MVGQMYCYPGSHLARALTRALALALVLALLVGPFLSGLAGAIPAPGGRWARDGQVPPASRSRSVLLDVSAGQLLMVDGRHPDAVAWANLTNAIRETGWAFLELGTSGQYNDSLQAYAAGVVEAAVSEELIYMHWMNTVVNYCGPFEYEVGYCERLKSFLEANLEWMQEEMESNPDSPYWHQVRLTLLQLKGLEDSYEGRVSFPAGKFTIKPLGFLLLQLSGDLEDLELALNKTKIKPSLGSGSCSALIKLLPGQSDLLVAHNTWNNYQHMLRVIKKYWLQFREGPWGDYPLVPGNKLVFSSYPGTIFSCDDFYILGSGLVTLETTIGNKNPALWKYVRPRGCVLEWVRNIVANRLASDGATWADIFKRFNSGTYNNQWMIVDYKAFIPGGPSPGSRVLTILEQIPGMVVVADKTSELYQKTYWASYNIPSFETVFNASGLQALVAQYGDWFSYDGSPRAQIFRRNQSLVQDMDSMVRLMRYNDFLHDPLSLCKACNPQPNGENAISARSDLNPANGSYPFQALRQRSHGGIDVKVTSMSLARILSLLAASGPTWDQVPPFQWSTSPFSGLLHMGQPDLWKFAPVKVSWD

SEQ ID NO: 12889 - protein, 557 aa, Artificial Sequence
  Description of Artificial Sequence: Synthetic coding sequence
MVGQMYCYPGSHLARALTRALALALVLALLVGPFLSGLAGAIPAPGGRWARDGQVPPASRSRSVLLDVSAGQLLMVDGRHPDAVAWANLTNAIRETGWAFLELGTSGQYNDSLQAYAAGVVEAAVSEELIYMHWMNTVVNYCGPFEYEVGYCERLKSFLEANLEWMQEEMESNPDSPYWHQVRLTLLQLKGLEDSYEGRVSFPAGKFTIKPLGFLLLQLSGDLEDLELALNKTKIKPSLGSGSCSALIKLLPGQSDLLVAHNTWNNYQHMLRVIKKYWLQFREGPWGDYPLVPGNKLVFSSYPGTIFSCDDFYILGSGLVTLETTIGNKNPALWKYVRPRGCVLEWVRNIVANRLASDGATWADIFKRFNSGTGMVVVADKTSELYQKTYWASYNIPSFETVFNASGLQALVAQYGDWFSYDGSPRAQIFRRNQSLVQDMDSMVRLMRYNDFLHDPLSLCKACNPQPNGENAISARSDLNPANGSYPFQALRQRSHGGIDVKVTSMSLARILSLLAASGPTWDQVPPFQWSTSPFSGLLHMGQPDLWKFAPVKVSWD

SEQ ID NO: 12890 - protein, 490 aa, Artificial Sequence
  Description of Artificial Sequence: Synthetic coding sequence
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 12891 - protein, 177 aa, Artificial Sequence
  Description of Artificial Sequence: Synthetic coding sequence
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADL

SEQ ID NO: 12892 - protein, 129 aa, Artificial Sequence
  Description of Artificial Sequence: Synthetic coding sequence
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTL

SEQ ID NO: 12893 - protein, 490 aa, Artificial Sequence; identical to SEQ ID NO: 12890
  Description of Artificial Sequence: Synthetic coding sequence

SEQ ID NO: 12894 - protein, 490 aa, Artificial Sequence; identical to SEQ ID NO: 12890
  Description of Artificial Sequence: Synthetic coding sequence

SEQ ID NO: 12895 - protein, 490 aa, Artificial Sequence; identical to SEQ ID NO: 12890
  Description of Artificial Sequence: Synthetic coding sequence

SEQ ID NO: 12896 - protein, 490 aa, Artificial Sequence; identical to SEQ ID NO: 12890
  Description of Artificial Sequence: Synthetic coding sequence

SEQ ID NO: 12897 - protein, 402 aa, Artificial Sequence
  Description of Artificial Sequence: Synthetic coding sequence
MKPKLMYQELKVPAEEPANELPMNEIEAWKAAEKKARWVLLVLILAVVGFGALMTQLFLWEYGDLHLFGPNQRPAPCYDPCEAVLVESIPEGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQALSPALPPLPPPPPA

SEQ ID NO: 12898 - protein, 506 aa, Artificial Sequence
  Description of Artificial Sequence: Synthetic coding sequence
MLKPLWKAAVAPTWPCSMPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEKTFQTYWVLGVPKAVLPKTWPQNFSSHFNRFQPFHGLFDGVPTTAYFSASPPALCPQGRTRDLEALLAVMGSAQEFIYASVMEYFPTTRFSHPPRYWPVLDNALRAAAFGKGVRVRLLVGCGLNTDPTMFPYLRSLQALSNPAANVSVDVKVFIVPVGNHSNIPFSRVNHSKFMVTEKAAYIGTSNWSEDYFSSTAGVGLVVTQSPGAQPAGATVQEQLRQLFERDWSSRYAVGLDGQAPGQDCVWQG

SEQ ID NO: 12899 - protein, 513 aa, Artificial Sequence
  Description of Artificial Sequence: Synthetic coding sequence
MPGCPVQMLKPLWKAAVAPTWPCSMPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEKTFQTYWVLGVPKAVLPKTWPQNFSSHFNRFQPFHGLFDGVPTTAYFSASPPALCPQGRTRDLEALLAVMGSAQEFIYASVMEYFPTTRFSHPPRYWPVLDNALRAAAFGKGVRVRLLVGCGLNTDPTMFPYLRSLQALSNPAANVSVDVKVFIVPVGNHSNIPFSRVNHSKFMVTEKAAYIGTSNWSEDYFSSTAGVGLVVTQSPGAQPAGATVQEQLRQLFERDWSSRYAVGLDGQAPGQDCVWQG

SEQ ID NO: 12900 - protein, 474 aa, Artificial Sequence
  Description of Artificial Sequence: Synthetic coding sequence
MSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKVLEALKLKGAEVTYMNMTAYNKGRLQSSFWIVDKQHVYIGSAGLDWQSLGQMKELGVIFYNCSCLVLDLQRIFALYSSLKFKSRVPQTWSKRLYGVYDNEKKLQLQLNETKSQAFVSNSPKLFCPKNRSFDIDAIYSVIDDAKQYVYIAVMDYLPISSTSTKRTYWPDLDAKIREALVLRSVRVRLLLSFWKETDPLTFNFISSLKAICTEIANCSLKVKFFDLERENACATKEQKNHTFPRLNRNKYMVTDGAAYIGNFDWVGNDFTQNAGTGLVINQADVRNNRSIIKQLKDVFERDWYSPYAKTLQPTKQPNCSSLFKLKPLSNKTATDDTGGKDPRNV

SEQ ID NO: 12901 - protein, 444 aa, Artificial Sequence
  Description of Artificial Sequence: Synthetic coding sequence
MRMDSQKKIAKINVGKRIALVENIPEGLNYSENAPFHLSLFQGWMNLLNMAKKSVDIVSSHWDLNHTHPSACQGQRLFEKLLQLTSQNIEIKLVSDVTADSKVLEALKLKGAEVTYMNMTAYNKGRLQSSFWIVDKQHVYIGSAGLDWQSLGQMKELGVIFYNCSCLVLDLQRIFALYSSLKFKSRVPQTWSKRLYGVYDNEKKLQLQLNETKSQAFVSNSPKLFCPKNRSFDIDAIYSVIDDAKQYVYIAVMDYLPISSTSTKRTYWPDLDAKIREALVLRSVRVRLLLSFWKETDPLTFNFISSLKAICTEIANCSLKVKFFDLERENACATKEQKNHTFPRLNRNKYMVTDGAAYIGNFDWVGNDFTQNAGTGLVINQADVRNNRSIIKQLKDVFERDWYSPYAKTLQPTKQPNCSSLFKLKPLSNKTATDDTGGKDPRNV

SEQ ID NO: 12902 - protein, 536 aa, Artificial Sequence
  Description of Artificial Sequence: Synthetic coding sequence
MEIRQHEWLSASPHEGFEQMRLKSRPKEPSPSLTRVGANFYSSVKQQDYSASVWLRRKDKLEHSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKVLEALKLKGAEVTYMNMTAYNKGRLQSSFWIVDKQHVYIGSAGLDWQSLGQMKELGVIFYNCSCLVLDLQRIFALYSSLKFKSRVPQTWSKRLYGVYDNEKKLQLQLNETKSQAFVSNSPKLFCPKNRSFDIDAIYSVIDDAKQYVYIAVMDYLPISSTSTKRTYWPDLDAKIREALVLRSVRVRLLLSFWKETDPLTFNFISSLKAICTEIANCSLKVKFFDLERENACATKEQKNHTFPRLNRNKYMVTDGAAYIGNFDWVGNDFTQNAGTGLVINQADVRNNRSIIKQLKDVFERDWYSPYAKTLQPTKQPNCSSLFKLKPLSNKTATDDTGGKDPRNV

SEQ ID NO: 12903 - protein, 252 aa, Artificial Sequence
  Description of Artificial Sequence: Synthetic coding sequence
MGRLSWQVAAAAAVGLALTLEALPWVLRWLRSRRRRPRREALFFPSQVTCTEALLRAPGAELAELPEGCPCGLPHGESALSRLLRALLAARASLDLCLFAFSSPQLGRAVQLLHQRGVRVRVVTDCDYMALNGSQIGLLRKAGIQVRHDQDPGYMHHKFAIVDKRVLITGSLNWTTQAIQNNRENVLITEDDEYVRLFLEEFERIWEQFNPTKYTFFPPKKSHGSCAPPVSRAGGRLLSWHRTCGTSSESQT

SEQ ID NO: 12904 - protein, 175 aa, Artificial Sequence
  Description of Artificial Sequence: Synthetic coding sequence
MGRLSWQVAAAARGAVLPVSGDLYRGPAAGSGRGAGRAPRGLPVRPAPRRERAKPPAACPAGRPRQPGSLPVRLLQPAAGPRRAVAAPAWGASAGRHRLRLHGPQRLANRSAAQGRDPGPARSRPRLHASQVCHRGQEGAHHWLAQLDHASHPEQQGECSHHGGRRVRAAFSGRI

SEQ ID NO: 12905 - protein, 225 aa, Artificial Sequence
  Description of Artificial Sequence: Synthetic coding sequence
MVSHSELRKLFYSADAVCFDVDSTVIREEGIDELAKICGVEDAVSEMTRRAMGGAVPFKAALTERLALIQPSREQVQRLIAEQPPHLTPGIRELVSRLQERNVQVFLISGGFRSIVEHVASKLNIPATNVFANRLKFYFNGEYAGFDETQPTAESGGKGKVIKLLKEKFHFKKIIMIGDGATDMEACPPADAFIGFGGNVIRQQVKDNAKWYITDFVELLGELEE

SEQ ID NO: 12906 - protein, 225 aa, Artificial Sequence; identical to SEQ ID NO: 12905
  Description of Artificial Sequence: Synthetic coding sequence

SEQ ID NO: 12907 - protein, 2 aa, Artificial Sequence
  Description of Artificial Sequence: Synthetic coding sequence
MV

SEQ ID NO: 12908 - protein, 2 aa, Artificial Sequence
  Description of Artificial Sequence: Synthetic coding sequence
MV

SEQ ID NO: 12909 - protein, 46 aa, Artificial Sequence
  Description of Artificial Sequence: Synthetic coding sequence
MVSHSELRKLFYSADAVCFDVDSTVIREEGIDELAKICGVEDAVSE

SEQ ID NO: 12910 - protein, 46 aa, Artificial Sequence; identical to SEQ ID NO: 12909
  Description of Artificial Sequence: Synthetic coding sequence

SEQ ID NO: 12911 - protein, 187 aa, Artificial Sequence
  Description of Artificial Sequence: Synthetic coding sequence
MVSHSELRKLFYSADAVCFDVDSTVIREEGIDELAKICGVEDAVSEMTRRAMGGAVPFKAALTERLALIQPSREQVQRLIAEQPPHLTPGIRELVSRLQERNVQVFLISGGFRSIVEHVASKLNIPATNVFANRLKFYFNGEYAGFDETQPTAESGGKGKVIKLLKEKFHFKKIIMIGDGATDMEAC

SEQ ID NO: 12912 - protein, 10 aa, Artificial Sequence
  Description of Artificial Sequence: Synthetic coding sequence
MVSHSELRKL

SEQ ID NO: 12913 - protein, 225 aa, Artificial Sequence; identical to SEQ ID NO: 12905
  Description of Artificial Sequence: Synthetic coding sequence

SEQ ID NO: 12914 - protein, 348 aa, Artificial Sequence
  Description of Artificial Sequence: Synthetic coding sequence
MKTAENIRGTGSDGPRKRGLCVLCGLPAAGKSTFARALAHRLQQEQGWAIGVVAYDDVMPDAFLAGARARPAPSQWKLLRQELLKYLEYFLMAVINGCQMSVPPNRTEAMWEDFITCLKDQDLIFSAAFEAQSCYLLTKTAVSRPLFLVLDDNFYYQSMRYEVYQLARKYSLGFCQLFLDCPLETCLQRNGQRPQALPPETIHLMGRKLEKPNPEKNAWEHNSLTIPSPACASEASLEVTDLLLTALENPVKYAEDNMEQKDTDRIICSTNILHKTDQTLRRIVSQTMKEAKGNQEAFSEMTFKQRWVRANHAAIWRIILGNEHIKCRSAKVGWLQCCRIEKRPLSTG

SEQ ID NO: 12915 - protein, 289 aa, Artificial Sequence
  Description of Artificial Sequence: Synthetic coding sequence
MKTAENIRGTGSDGPRKRGLCVLCGLPAAGKSTFARALAHRLQQEQGWAIGVVAYDDVMPDAFLAGARARPAPSQWKLLRQELLKYLEYFLMAVINGCQMSVPPNRTEAMWEDFITCLKDQDLIFSAAFEAQSCYLLTKTAVSRPLFLVLDDNFYYQSMRYEVYQLARKYSLGFCQLFLDCPLETCLQRNGQRPQALPPETIHLMGRKLEKPNPEKNAWEHNSLTIPSPACASEASLEVTDLLLTALENPVKYAEDNMEQKVNFQCKFNVNEKEQLFVGRSFEPNIKCE

SEQ ID NO: 12916 - protein, 359 aa, Artificial Sequence
  Description of Artificial Sequence: Synthetic coding sequence
  MOD_RES (1)..(1): Any amino acid
XMKTAENIRGTGSDGPRKRGLCVLCGLPAAGKSTFARALAHRLQQEQGWAIGVVAYDDVMPDAFLAGARARPAPSQWKLLRQELLKYLEYFLMAVINGCQMSVPPNRTEAMWEDFITCLKDQDLIFSAAFEAQSCYLLTKTAVSRPLFLVLDDNFYYQSMRYEVYQLARKYSLGFCQLFLDCPLETCLQRNGQRPQALPPETIHLMGRKLEKPNPEKNAWEHNSLTIPSPACASEASLEVTDLLLTALENPVKYAEDNMEQKDTDRIICSTNILHKTDQTLRRIVSQTMKEAKDEQVLPHNLKLLAEELNKLKAEFLEDLKQGNKKYLCFQQTIDIPDVISFFHYEKDNIVQKYFSKQH

SEQ ID NO: 12917 - protein, 2521 aa, Artificial Sequence
  Description of Artificial Sequence: Synthetic coding sequence
MEPHVLGAVLYWLLLPCALLAACLLRFSGLSLVYLLFLLLLPWFPGPTRCGLQGHTGRLLRALLGLSLLFLVAHLALQICLHIVPRLDQLLGPSCSRWETLSRHIGVTRLDLKDIPNAIRLVAPDLGILVVSSVCLGICGRLARNTRQSPHPRELDDDERDVDASPTAGLQEAATLAPTRRSRLAARFRVTAHWLLVAAGRVLAVTLLALAGIAHPSALSSVYLLLFLALCTWWACHFPISTRGFSRLCVAVGCFGAGHLICLYCYQMPLAQALLPPAGIWARVLGLKDFVGPTNCSSPHALVLNTGLDWPVYASPGVLLLLCYATASLRKLRAYRPSGQRKEAAKGYEARELELAELDQWPQERESDQHVVPTAPDTEADNCIVHELTGQSSVLRRPVRPKRAEPREASPLHSLGHLIMDQSYVCALIAMMVWSITYHSWLTFVLLLWACLIWTVRSRHQLAMLCSPCILLYGMTLCCLRYVWAMDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSGLGAEEPLSSMTDDMGSPLSTGYHTRSGSEEAVTDPGEREAGASLYQGLMRTASELLLDRRLRIPELEEAELFAEGQGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 12918 - protein, 373 aa, Artificial Sequence
  Description of Artificial Sequence: Synthetic coding sequence
MKICPFSSKSSIVLALKFRSLIHFEKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKHHGAVRVHRAGHRQVRARILQRDLALHYVRGAAVRGPHPQALPGHLPGAGDSGAGAGGGVVRQAHLPLPLTGDHDQVDS

SEQ ID NO: 12919 - protein, 2467 aa, Artificial Sequence
  Description of Artificial Sequence: Synthetic coding sequence
  MOD_RES (1)..(1): Any amino acid
XTGRLLRALLGLSLLFLVAHLALQICLHIVPRLDQLLGPSCSRWETLSRHIGVTRLDLKDIPNAIRLVAPDLGILVVSSVCLGICGRLARNTRQSPHPRELDDDERDVDASPTAGLQEAATLAPTRRSRLAARFRVTAHWLLVAAGRVLAVTLLALAGIAHPSALSSVYLLLFLALCTWWACHFPISTRGFSRLCVAVGCFGAGHLICLYCYQMPLAQALLPPAGIWARVLGLKDFVGPTNCSSPHALVLNTGLDWPVYASPGVLLLLCYATASLRKLRAYRPSGQRKEAAKGYEARELELAELDQWPQERESDQHVVPTAPDTEADNCIVHELTGQSSVLRRPVRPKRAEPREASPLHSLGHLIMDQSYVCALIAMMVWSITYHSWLTFVLLLWACLIWTVRSRHQLAMLCSPCILLYGMTLCCLRYVWAMDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSGLGAEEPLSSMTDDMGSPLSTGYHTRSGSEEAVTDPGEREAGASLYQGLMRTASELLLDRRLRIPELEEAELFAEGQGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 12920 - protein, 554 aa, Artificial Sequence
  Description of Artificial Sequence: Synthetic coding sequence
MPDYRTRALFVQSTLGDSAGPELQLLSIVPGRDLQPSDSFTASSSPPPSVWSELEHIRGKSEATTELKRPSLPGSIHSCLCGVWCGVGKRTPSSLVSSLQDLELLGQRQRQLWMESTPRPPYNPFLVPCTPVGKLSAEHGGPTRKMPPSASAVDFFQLFVPDNVLKNMVVQTNMYAKKFQERFGSDGAWVEVTLTEMKAFLGYMISTSISHCESVLSIWSGGFYSNRSLALVMSQARFEKILKYFHVVAFRSSQTTHGLYKVQPFLDSLQNSFDSAFRPSQTQVLHEPLIDEDPVFIATCTERELRKRKKRKFSLWVRQCSSTGFIIQIYVHLKEGGGPDGLDALKNKPQLHSMVARSLCRNAAGKNYIIFTGPSITSLTLFEEFEKQGIYCCGLLRARKSDCTGLPLSMLTNPATPPARGQYQIKMKGNMSLICWYNKGHFRFLTNAYSPVQQGVIIKRKSGEIPCPLAVEAFAAHLSYICRYDDKYSKYFISHKPNKTWQQVFWFAISIAINNAYILYKMSDAYHVKRYSRAQFGERLVRELLGLEDASPTH

SEQ ID NO: 12921 - protein, 455 aa, Artificial Sequence
  Description of Artificial Sequence: Synthetic coding sequence
MPDYRTRALFVQSTLGDSAGPELQLLSIVPGRDLQPSDSFTGPTRKMPPSASAVDFFQLFVPDNVLKNMVVQTNMYAKKFQERFGSDGAWVEVTLTEMKAFLGYMISTSISHCESVLSIWSGGFYSNRSLALVMSQARFEKILKYFHVVAFRSSQTTHGLYKVQPFLDSLQNSFDSAFRPSQTQVLHEPLIDEDPVFIATCTERELRKRKKRKFSLWVRQCSSTGFIIQIYVHLKEGGGPDGLDALKNKPQLHSMVARSLCRNAAGKNYIIFTGPSITSLTLFEEFEKQGIYCCGLLRARKSDCTGLPLSMLTNPATPPARGQYQIKMKGNMSLICWYNKGHFRFLTNAYSPVQQGVIIKRKSGEIPCPLAVEAFAAHLSYICRYDDKYSKYFISHKPNKTWQQVFWFAISIAINNAYILYKMSDAYHVKRYSRAQFGERLVRELLGLEDASPTH

SEQ ID NO: 12922 - protein, 1037 aa, Artificial Sequence
  Description of Artificial Sequence: Synthetic coding sequence
MSPPLCPLLLLAVGLRLAGTLNPSDPNTCSFWESFTTTTKESHSRPFSLLPSEPCERPWEGPHTCPQPTVVYRTVYRQVVKTDHRQRLQCCHGFYESRGFCVPLCAQECVHGRCVAPNQCQCVPGWRGDDCSSECAPGMWGPQCDKPCSCGNNSSCDPKSGVCSCPSGLQPPNCLQPCTPGYYGPACQFRCQCHGAPCDPQTGACFCPAERTGPSCDVSCSQGTSGFFCPSTHSCQNGGVFQTPQGSCSCPPGWMGTICSLPCPEGFHGPNCSQECRCHNGGLCDRFTGQCRCAPGYTGDRCREECPVGRFGQDCAETCDCAPDARCFPANGACLCEHGFTGDRCTDRLCPDGFYGLSCQAPCTCDREHSLSCHPMNGECSCLPGWAGLHCNESCPQDTHGPGCQEHCLCLHGGVCQATSGLCQCAPGYTGPHCASLCPPDTYGVNCSARCSCENAIACSPIDGECVCKEGWQRGNCSVPCPPGTWGFSCNASCQCAHEAVCSPQTGACTCTPGWHGAHCQLPCPKGQFGEGCASRCDCDHSDGCDPVHGRCQCQAGWMGARCHLSCPEGLWGVNCSNTCTCKNGGTCLPENGNCVCAPGFRGPSCQRSCQPGRYGKRCVPCKCANHSFCHPSNGTCYCLAGWTGPDCSQPCPPGHWGENCAQTCQCHHGGTCHPQDGSCICPLGWTGHHCLEGCPLGTFGANCSQPCQCGPGEKCHPETGACVCPPGHSGAPCRIGIQEPFTVMPTTPVAYNSLGAVIGIAVLGSLVVALVALFIGYRHWQKGKEHHHLAVAYSSGRLDGSEYVMPDVPPSYSHYYSNPSYHTLSQCSPNPPPPNKVPGPLFASLQNPERPGGAQGHDNHTTLPADWKHRREPPPGPLDRGSSRLDRSYSYSYSNGPGPFYNKGLISEEELGASVASLSSENPYATIRDLPSLPGGPRESSYMEMKGPPSGSPPRQPPQFWDSQRRRQPQPQRDSGTYEQPSPLIHDRDSVGSQPPLPPGLPPGHYDSPKNSHIPGHYDLPPVRHPPSPPLRRQDR

SEQ ID NO: 12923 - protein, 1037 aa, Artificial Sequence; identical to SEQ ID NO: 12922
  Description of Artificial Sequence: Synthetic coding sequence

SEQ ID NO: 12924 - protein, 173 aa, Artificial Sequence
  Description of Artificial Sequence: Synthetic coding sequence
MSPPLCPLLLLAVGLRLAGTLNPSDPNTCSFWESFTTTTKESHSRPFSLLPSEPCERPWEGPHTCPQPTVVYRTVYRQVVKTDHRQRLQCCHGFYESRGFCVPLCAQECVHGRCVAPNQCQCVPGWRGDDCSSECAPGMWGPQCDKPCSCGNNSSCDPKSGVCSCPSGLQPPN

SEQ ID NO: 12925 - protein, 771 aa, Artificial Sequence
  Description of Artificial Sequence: Synthetic coding sequence
MEEDKLLSAVPEEGDATRDPGPEPEEEPGVRNGMASEGLNSSLCSPGHERRGTPADTEEPTKDPDVAFHGLSLGLSLTNGLALGPDLNILEDSAESRPWRAGVLAEGDNASRSLYPDAEDPQLGLDGPGEPDVRDGFSATFEKILESELLRGTQYSSLDSLDGLSLTDESDSCVSFEAPLTPLIQQRARDSPEPGAGLGIGDMAFEGDMGAAGGDGELGSPLRRSISSSRSENVLSRLSLMAMPNGFHEDGPQGPGGDEDDDEEDTDKLLNSASDPSLKDGLSDSDSELSSSEGLEPGSADPLANGCQGVSEAAHRLARRLYHLEGFQRCDVARQLGKNNEFSRLVAGEYLSFFDFSGLTLDGALRTFLKAFPLMGETQERERVLTHFSRRYCQCNPDDSTSEDGIHTLTCALMLLNTDLHGHNIGKKMSCQQFIANLDQLNDGQDFAKDLLKTLYNSIKNEKLEWAIDEDELRKSLSELVDDKFGTGTKKVTRILDGGNPFLDVPQALSATTYKHGVLTRKTHADMDGKRTPRGRRGWKKFYAVLKGTILYLQKDEYRPDKALSEGDLKNAIRVHHALATRASDYSKKSNVLKLKTADWRVFLFQAPSKEEMLSWILRINLVAAIFSAPAFPAAVSSMKKFCRPLLPSCTTRLCQEEQLRSHENKLRQLTAELAEHRCHPVERGIKSKEAEEYRLKEHYLTFEKSRYETYIHLLAMKIKVGSDDLERIEARLATLEGDDPSLRKTHSSPALSQGHVTGSKTTKDATGPDT

SEQ ID NO: 12926 - protein, 866 aa, Artificial Sequence
  Description of Artificial Sequence: Synthetic coding sequence
MEEEDTKREVPKEDGVGDVQHFDSSKIMEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEHFQGP

SEQ ID NO: 12927 - protein, 1237 aa, Artificial Sequence
  Description of Artificial Sequence: Synthetic coding sequence
MEEEDTKREVPKEDGVGDVQHFDSSKIMEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEHFRSLEERKKQHKEGLYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 12928 - protein, 1253 aa, Artificial Sequence
  Description of Artificial Sequence: Synthetic coding sequence
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKEKVKLDAEREKLERLQELYSEQKTQLDNCPESMREQLQQQLKRDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEHFRSLEERKKQHKEGLYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 12929 - protein, 1210 aa, Artificial Sequence
  Description of Artificial Sequence: Synthetic coding sequence
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEHFRSLEERKKQHKEGLYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 12930 - protein, 1253 aa, Artificial Sequence; identical to SEQ ID NO: 12928
  Description of Artificial Sequence: Synthetic coding sequence

SEQ ID NO: 12931 - protein, 1210 aa, Artificial Sequence; identical to SEQ ID NO: 12929
  Description of Artificial Sequence: Synthetic coding sequence

SEQ ID NO: 12932 - protein, 1115 aa, Artificial Sequence
  Description of Artificial Sequence: Synthetic coding sequence
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEHFRSLEERKKQHKEGLYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIK

SEQ ID NO: 12933 - protein, 1871 aa, Artificial Sequence
  Description of Artificial Sequence: Synthetic coding sequence
MPSVCLLLLLFLAVGGALGNRPFRAFVVTDTTLTHLAVHRVTGEVFVGAVNRVFKLAPNLTELRAHVTGPVEDNARCYPPPSMRVCAHRLAPVDNINKLLLIDYAARRLVACGSIWQGICQFLRLDDLFKLGEPHHRKEHYLSGAQEPDSMAGVIVEQGQGPSKLFVGTAVDGKSEYFPTLSSRKLISDEDSADMFSLVYQDEFVSSQIKIPSDTLSLYPAFDIYYIYGFVSASFVYFLTLQLDTQQTLLDTAGEKFFTSKIVRMCAGDSEFYSYVEFPIGCSWRGVEYRLVQSAHLAKPGLLLAQALGVPADEDVLFTIFSQGQKNRASPPRQTILCLFTLSNINAHIRRRIQSCYRGEGTLALPWLLNKELPCINTPMQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGDNLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 12934 - protein, 1568 aa, Artificial Sequence
  Description of Artificial Sequence: Synthetic coding sequence
MEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPSTWYFLIVLPVLLVIVIFAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 12935 - protein, 615 aa, Artificial Sequence
  Description of Artificial Sequence: Synthetic coding sequence
MQHLCLLAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 12936 - protein, 530 aa, Artificial Sequence
  Description of Artificial Sequence: Synthetic coding sequence
MGRLLRAARLPPLLSPLLLLLVGGAFLGACVAGSDEPGPEGLTSTSLLDLLLPTGLEPLDSEEPSETMGLGAGLGAPGSGFPSEENEESRILQPPQYFWEEEEELNDSSLDLGPTADYVFPDLTEKAGSIEDTSQAQELPNLPSPLPKMNLVEPPWHMPPREEEEEEEEEEEREKEEVEKQEEEEEEELLPVNGSQEEAKPQVRDFSLTSSSQTPGATKSRHEDSGDQASSGVEVESSMGPSLLLPSVTPTTVTPGDQDSTSQEAEATVLPAAGLGVEFEAPQEASEEATAGAAGLSGQHEEVPALPSFPQTTAPSGAEHPDEDPLGSRTSASSPPQLLALVEEVLPRHGSGHHGAWHISLSKPSEKEQHLLMTLVGEQGVVPTQDVLSMLGDIRRSLEEIGIQNYSTTSSCQARASQVRSDYGTLFVVLVVIGAICIIIIALGLLYNCWQRRLPKLKHVSHGEELRFVENGCHDNPTLDVASDSQSEMQEKHPSLNGGGALNGPGSWGALMGGKRDPEDSDVFEEDTHL

SEQ ID NO: 12937 - protein, 605 aa, Artificial Sequence
  Description of Artificial Sequence: Synthetic coding sequence
MGRLLRAARLPPLLSPLLLLLVGGAFLGACVAGSDEPGPEGLTSTSLLDLLLPTGLEPLDSEEPSETMGLGAGLGAPGSGFPSEENEESRILQPPQYFWEEEEELNDSSLDLGPTADYVFPDLTEKAGSIEDTSQAQELPNLPSPLPKMNLVEPPWHMPPREEEEEEEEEEEREKEEVEKQEEEEEEELLPVNGSQEEAKPQVRDFSLTSSSQTPGATKSRHEDSGDQASSGVEVESSMGPSLLLPSVTPTTVTPGDQDSTSQEAEATVLPAAGLGVEFEAPQEASEEATAGAAGLSGQHEEVPALPSFPQTTAPSGAEHPDEDPLGSRTSASSPLAPGDMELTPSSATLGQEDLNQQLLEGQAAEAQSRIPWDSTQVICKDWSNLAGKNYIILNMTENIDCEVFRQHRGPQLLALVEEVLPRHGSGHHGAWHISLSKPSEKEQHLLMTLVGEQGVVPTQDVLSMLGDIRRSLEEIGIQNYSTTSSCQARASQVRSDYGTLFVVLVVIGAICIIIIALGLLYNCWQRRLPKLKHVSHGEELRFVENGCHDNPTLDVASDSQSEMQEKHPSLNGGGALNGPGSWGALMGGKRDPEDSDVFEEDTHL

SEQ ID NO: 12938 - protein, 238 aa, Artificial Sequence
  Description of Artificial Sequence: Synthetic coding sequence
MLTPLGKFSTAKFAVRLPRVWEARAPSLSGAPAPTPPAPPPSRSSRLGLWPRCFLIFPQLRILLLGPQESNNSTGTMWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYSP

SEQ ID NO: 12939 - protein, 236 aa, Artificial Sequence
  Description of Artificial Sequence: Synthetic coding sequence
MLTPLGKFSTAKFAVRLPRVWEARAPSLSGAPAPTPPAPPPSRSSRLGLWPRCFLIFPQLRILLLGPQESNNSTGTMWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRP

SEQ ID NO: 12940 - protein, 120 aa, Artificial Sequence
  Description of Artificial Sequence: Synthetic coding sequence
MPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYSP

SEQ ID NO: 12941 - protein, 118 aa, Artificial Sequence
  Description of Artificial Sequence: Synthetic coding sequence
MPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRP

SEQ ID NO: 12942 - protein, 120 aa, Artificial Sequence; identical to SEQ ID NO: 12940
  Description of Artificial Sequence: Synthetic coding sequence

SEQ ID NO: 12943 - protein, 120 aa, Artificial Sequence; identical to SEQ ID NO: 12940
  Description of Artificial Sequence: Synthetic coding sequence

SEQ ID NO: 12944 - protein, 326 aa, Artificial Sequence
  Description of Artificial Sequence: Synthetic coding sequence
MRTEAQVPALQPPEPGLEGAMGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 12945 - protein, 323 aa, Artificial Sequence
  Description of Artificial Sequence: Synthetic coding sequence
MQPSGWAAAREAAGRDMLAADLRCSLFASALQSYKRDSVLRPFPASYARGDCKDFEALLADASKLPNLKELLQSSGDNHKRAWDLVSWILSSKVLTIHSAGKAEFEKIQKLTGAPHTPVPAPDFLFEIEYFDPANAKFYETKGERDLIYAFHGSRLENFHSIIHNGLHCHLNKTSLFGEGTYLTSDLSLALIYSPHGHGWQHSLLGPILSCVAVCEVIDHPDVKCQTKKKDSKEIDRRRARIKHSEGGDIPPKYFVVTNNQLLRVKYLLVYSQKPPKSRASSQLSWFSSHWFTVMISLYLLLLLIVSVINSSAFQHFWNRAKR

SEQ ID NO: 12946 - protein, 520 aa, Artificial Sequence
  Description of Artificial Sequence: Synthetic coding sequence
MFCTRGLLFFAFLAGLDIEFTGLRSNLSGPQQISLFDLPSEWYLKTRQSVQQFTVCQIGLSVFSAIEGEANKYIAHSCNFYLFPTTFGILDSEFSFQASSVQFLNQYGFNYNKFLKNGIPYMNEEQEKKIRHDILTGNWRVRSSPDKDQIKVVIDEVTRWLELAKEGDWMTLPGITGFQAFEVQLVLRQALPNIWTVLKDEGVVVKKVSKQHRWYLQNTSCDRESCWKENILLSARGFSVFFQMLVKAQKPLVGHNMMMDLLHLHEKFFRPLPESYDQFKQNIHSLFPVLIDTKSVTKDIWKEMNFPRVSNLSEVYEVLNSDLNPTKNSGPEIVHASRCEKYVETKCPHEAAYDAFLCGSVLLKVAHLLLQKIYHIDPVPESSFPQYLDVLAPYVNQVNLIRAGVPKINFSGPDYPSIRPPILILSVKRWPGVSEQQVYHKFQNLCKFDVRRLTRSQFLLLTNKFKDARNILKEYRDHPTLCISLYRYWRHSPNVNCLLQVCGIVTAWALLAFILGRSGT

SEQ ID NO: 12947 - protein, 263 aa, Artificial Sequence
  Description of Artificial Sequence: Synthetic coding sequence
MDNSWRLGPAIGLSAGQSQLLVSLLLLLTRVQPGTDVAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTCFNSCRSTSLSGPEEAGSVRRYTTHLAFSTPAEGAS

SEQ ID NO: 12948 - protein, 783 aa, Artificial Sequence
  Description of Artificial Sequence: Synthetic coding sequence
MAACRYCCSCLRLRPLSDGPFLLPRRDRALTQLQVRALWSSAGSRAVAVDLGNRKLEISSGKLARFADGSAVVQSGDTAVMVTAVSKTKPSPSQFMPLVVDYRQKAAAAGRIPTNYLRREIGTSDKEILTSRIIDRSIRPLFPAGYFYDTQVLCNLLAVDGVNEPDVLAINGASVALSLSDIPWNGPVGAVRIGIIDGEYVVNPTRKEMSSSTLNLVVAGAPKSQIVMLEASAENILQQDFCHAIKVGVKYTQQIIQGIQQLVKETGVTKRTPQKLFTPSPEIVKYTHKLAMERLYAVFTDYEHDKVSRDEAVNKIRLDTEEQLKEKFPEADPYEIIESFNVVAKEVFRSIVLNEYKRCDGRDLTSLRNVSCEVDMFKTLHGSALFQRGQTQVLCTVTFDSLESGIKSDQVITAINGIKDKNFMLHYEFPPYATNEIGKVTGLNRRELGHGALAEKALYPVIPRDFPFTIRVTSEVLESNGSSSMASACGGSLALMDSGVPISSAVAGVAIGLVTKTDPEKGEIEDYRLLTDILGIEDYNGDMDFKIAGTNKGITALQADIKLPGIPIKIVMEAIQQASVAKKEILQIMNKTISKPRASRKENGPVVETVQVPLSKRAKFVGPGGYNLKKLQAETGVTISQVDEETFSVFAPTPSAMHEARDFITEICKDDQEQQLEFGAVYTATITEIRDTGVMVKLYPNMTAVLLHNTQLDQRKIKHPTALGLEVGQEIQVKYFGRDPADGRMRLSRKVLQSPATTVVRTLNDRSSIVMGEPISQSSSNSQ

SEQ ID NO: 12949 - protein, 783 aa, Artificial Sequence; identical to SEQ ID NO: 12948
  Description of Artificial Sequence: Synthetic coding sequence

SEQ ID NO: 12950 - protein, 984 aa, Artificial Sequence
  Description of Artificial Sequence: Synthetic coding sequence
MVCSPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGSAALSFSIGAGSKTPGARQRLQARRQHTRKK

SEQ ID NO: 12951 - protein, 984 aa, Artificial Sequence; identical to SEQ ID NO: 12950
  Description of Artificial Sequence: Synthetic coding sequence

SEQ ID NO: 12952 - protein, 999 aa, Artificial Sequence
  Description of Artificial Sequence: Synthetic coding sequence
MVCSPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGNTFAHQQEHSPRKGPNNLSKRKLLPAVRAQGLPRRGQASSFPTRKE

SEQ ID NO: 12953 - protein, 1249 aa, Artificial Sequence
  Description of Artificial Sequence: Synthetic coding sequence
MSPAAAAAGAGERRRPIASVRDGRGRGCGGPARAVLLGLSLVGLLLYLVPAAAALAWLTVGATAAWWGLSREPRGSRPLSSFVRKARHRRPLSSFVRKARHRRTLFASPLAKSTANGNLLEPRTLLEGPDPAELLLMGSYLGKPGPPQPAAAPEGQDLRDRPGRRPPARPAPRSPPPRSPPPRSPPPSPPTHRAHHVYPSLPTPLLRPSRRPSPRDCGTLPNRFVITPRRRYPIHQAQYSCLGVLPTVCWNGYHKKAVLSPRNSRMVCSPVTVRIAPPDRRFSRSAIPEQIISSTLSSPSSNAPDPCAKETVLSALKEKEKKRTVEEEDQIFLDGQENKRRRHDSSGSGHSAFEPLVANGVPASFVPKPGSLKRGLNSQSSDDHLNKRSRSSSMSSLTGAYASGIPSSSRNAITSSYSSTRGISQLWKRNGPSSSPFSSPASSRSQTPERPAKKIREEELCHHSSSSTPLAADRESQGEKAADTTPRKKQNSNSQSTPGSSGQRKRKVQLLPSRRGEQLTLPPPPQLGYSITAEDLDLEKKASLQWFNQALEDKSDAASNSVTETPPITQPSFTFTLPAAAPASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSAPPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLHTAVPTATSSSAADFSGFGSTLATSAPATSSQPTLTFSNTSTPTFNIPFGSSAKSPLPSYPGANPQPAFGAAEGQPPGAAKPALAPSFGSSFTFGNSAAPAAAPTPAPPSMIKVVPAYVPTPIHPIFGGATHSAFGLKATASAFGAPASSQPAFGGSTAVFFGAATSSGFGATTQTASSGSSSSVFGSTTPSPFTFGGSAAPAGSGSFGINVATPGSSTTTGAFSFGAGQSGSTATSTPFAGGLGQNALGTTGQSTPFAFNVSSTTESKPVFGGTATPTFGLNTPAPGVGTSGSSLSFGASSAPAQGFVGVAPFGSAALSFSIGAGSKTPGARQRLQARRQHTRKK

SEQ ID NO: 12954 - protein, 999 aa, Artificial Sequence; identical to SEQ ID NO: 12952
  Description of Artificial Sequence: Synthetic coding sequence

SEQ ID NO: 12955 - protein, 1229 aa, Artificial Sequence [sequence omitted]

SEQ ID NO: 12956 - protein, 42 aa, Artificial Sequence
  Description of Artificial Sequence: Synthetic coding sequence
MVCSPVTVRIAPPDRRFSRSAIPEQIISSTLSSPSSNAPDPC

SEQ ID NO: 12957 - protein, 987 aa, Artificial Sequence
  Description of Artificial Sequence: Synthetic coding sequence
MVCSPVTVRIAPPDRRFSRSAIPEQIISSTLSSPSSNAPDPCAKETVLSALKEKKKKRTVEEEDQIFLDGQENKRRRHDSSGSGHSAFEPLVASGVPASFVPKPGSLKRGLNSQSSDDHLNKRSRSSSMSSLTGAYTSGIPSSSRNAITSSYSSTRGISQLWKRNGPSSSPFSSPASSRSQTPERPAKKIREEELCHHSSSSTPLAADKESQGEKAADTTPRKKQNSNSQSTPGSSGQRKRKVQLLPSRRGEQLTLPPPPQLGYSITAEDLDLEKKASLQWFNQALEDKSDAASNSVTETPPTTQPSFTFTLPAAATASPPTSLLAPSTNPLLESLKKMQTPPSLPPCPESAGAATTEALSPPKTPSLLPPLGLSQSGPPGLLPSPSFDSKPPTTLLGLIPAPSMVPATDTKAPPTLQAETATKPQATSAPSPAPKQSFLFGTQNTSPSSPAAPAASSASPMFKPIFTAPPKSEKEGPTPPGPSVTATAPSSSSLPTTTSTTAPTFQPVFSSMGPPASVPLPAPFFKQTTTPATAPTTTAPLFTGLASATSAVAPITSASPSTDSASKPAFGFGINSVSSSSVSTTTSTATAASQPFLFGAPQASAASFTPAMGSIFQFGKPPALPTTTTVTTFSQSLPTAVPTATSSSAADFSGFGSTLATSAPATSSQPTLTFSNTSTPTFNIPFGSSAKSPLPSYPGANPQPAFGAAEGQPPGAAKPALTPSFGSSFTFGNSAAPAPATAPTPAPASTIKIVPAHVPTPIQPTFGGATHSAFGLKATASAFGAPASSQPAFGGSTAVFSFGAATSSGFGATTQTASSGSSSSVFGSTTPSPFTFGGSAAPAGSGSFGINVATPGSSATTGAFSFGAGQSGSTATSTPFTGGLGQNALGTTGQSTPFAFNVGSTTESKPVFGGTATPTFGQNTPAPGVGTSGSSLSFGASSAPAQGFVGVGPFGSAAPSFSIGAGSKTPGARQRLQARRQHTRKK

SEQ ID NO: 12958 - protein, 315 aa, Artificial Sequence
  Description of Artificial Sequence: Synthetic coding sequence
MYQVPLPLDRDGTLVRLRFTMVALVTVCCPLVAFLFCILWSLLFHFKETTATHCGATPCRMFSAASQPLDPDGTLFRLRFTAMVWWAITFPVFGFFFCIIWSLVFHFEYTVATDCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 12959 - protein, 307 aa, Artificial Sequence
  Description of Artificial Sequence: Synthetic coding sequence
MARLGSTGGVSGRVVTQHRDSAPFLGAPRLGLRELGPIRGTAPEWHGRWNAAERSDKMYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTDRKSYSWKQRLFIINFISFFSALAVYFRHNMYCEAGVYTIFAILEYTVVLTNMAFHMTAWWDFGNKELLITSQPEEKRF

SEQ ID NO: 12960 - protein, 315 aa, Artificial Sequence; identical to SEQ ID NO: 12958
  Description of Artificial Sequence: Synthetic coding sequence

SEQ ID NO: 12961 - protein, 161 aa, Artificial Sequence
  Description of Artificial Sequence: Synthetic coding sequence
MVDGTQLRGAQLPALGELSHRRGGAPALRVAFLHRPALGASLLGGLRLLEPLPQLHLPVFLLSPALPPQLRPQCRGEPRVASAHLCLLLRGLHHPRKCFHCVHCLIPRAHAPHLHSLAVDQEAHSKSGGSQVLQLETAALHHQLHLLLLGAGCLLSAQHVL

SEQ ID NO: 12962 - protein, 254 aa, Artificial Sequence
  Description of Artificial Sequence: Synthetic coding sequence
MYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 12963 - protein, 345 aa, Artificial Sequence
  Description of Artificial Sequence: Synthetic coding sequence
  MOD_RES (1)..(1): Any amino acid
XRLGLRELGPIRGTAPEWHGRWNAAERSDKMYQVPLPLDRDGTLVRLRFTMVALVTVCCPLVAFLFCILWSLLFHFKETTATHCGATPCRMFSAASQPLDPDGTLFRLRFTAMVWWAITFPVFGFFFCIIWSLVFHFEYTVATDCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 12964 - protein, 207 aa, Artificial Sequence [sequence omitted]

SEQ ID NO: 12965 - protein, 311 aa, Artificial Sequence
  Description of Artificial Sequence: Synthetic coding sequence
MARLGSTGGVSGRVVTQHRDSAPFLGAPRLGLRELGPIRGTAPEWHGRWNAAERSDKMYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 12966 - protein, 232 aa, Artificial Sequence
  Description of Artificial Sequence: Synthetic coding sequence
MYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEVRSIPSGGSKAAQKKIKDICPQDSGSQVLQLETAALHHQLHLLLLGAGCLLSAQHVL

SEQ ID NO: 12967 - protein, 56 aa, Artificial Sequence
  Description of Artificial Sequence: Synthetic coding sequence
MYQVPLPLDRDGTLVRLRFTMVALVTVCCPLVAFLFCILWSLLFHFKETTATHCGD

SEQ ID NO: 12968 - protein, 320 aa, Artificial Sequence
  Description of Artificial Sequence: Synthetic coding sequence
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 12969 - protein, 264 aa, Artificial Sequence
  Description of Artificial Sequence: Synthetic coding sequence
MSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 12970 - protein, 269 aa, Artificial Sequence
  Description of Artificial Sequence: Synthetic coding sequence
MAGLAARLVLLAGAAALASGSQGDREPVYRDCVLQCEEQNCSGGALNHFRSRQPIYMSLAGWTCRDDCKYECMWVTVGLYLQEGHKVPQFHGKVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 12971 - protein, 299 aa, Artificial Sequence
  Description of Artificial Sequence: Synthetic coding sequence
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 12972 - protein, 272 aa, Artificial Sequence
  Description of Artificial Sequence: Synthetic coding sequence
MSSQELVTLNVGGKIFTTRFSTIKQFPASRLARMLDGRDQEFKMVGGQIFVDRDGDLFSFILDFLRTHQLLLPTEFSDYLRLQREALFYELRSLVDLLNPYLLQPRPALVEVHFLSRNTQAFFRVFGSCSKTIEMLTGRITVFTEQPSAPTWNGNFFPPQMTLLPLPPQRPSYHDLVFQCGSDSTTDNQTGVRYVSIKPDNRKLANGTNVLGLLIDTLLKEGFHLVSTRTVSSEDKTECYSFERIKSPEVLITNETPKPETIIIPEQSQIKK

SEQ ID NO: 12973 - protein, 229 aa, Artificial Sequence
  Description of Artificial Sequence: Synthetic coding sequence
MSSQELVTLNVGGKIFTTRFSTIKQFPASRLARMLDGRDQEFKMVGGQIFVDRDGDLFSFILDFLRTHQLLLPTEFSDYLRLQREALFYELRSLVDLLNPYLLQPRPALVEVHFLSRNTQAFFRVFGSCSKTIEMLTGRITVFTEQPSAPTWNGNFFPPQMTLLPLPPQRPSYHDLVFQCGSDSTTDNQTGVRLVCNGVISAHHNLRLWGSSDSPASASRVAGITGMFL

SEQ ID NO: 12974 - protein, 325 aa, Artificial Sequence
  Description of Artificial Sequence: Synthetic coding sequence
MALADSTRGLPNGGGGGGGSGSSSSSAEPPLFPDIVELNVGGQVYVTRRCTVVSVPDSLLWRMFTQQQPQELARDSKGRFFLDRDGFLFRYILDYLRDLQLVLPDYFPERSRLQREAEYFELPELVRRLGAPQQPGPGPPPSRRGVHKEGSLGDELLPLGYSEPEQQEGASAGAPSPTLELASRSPSGGAAGPLLTPSQSLDGSRRSGYITIGYRGSYTIGRDAQADAKFRRVARITVCGKTSLAKEVFGDTLNESRDPDRPPERYTSRYYLKFNFLEQAFDKLSESGFHMVACSSTGTCAFASSTDQSEDKIWTSYTEYVFCRE

SEQ ID NO: 12975 - protein, 325 aa, Artificial Sequence; identical to SEQ ID NO: 12974
  Description of Artificial Sequence: Synthetic coding sequence

SEQ ID NO: 12976 - protein, 255 aa, Artificial Sequence
  Description of Artificial Sequence: Synthetic coding sequence
MWQGCAVERPVGRMTSQTPLPQSPRPRRPTMSTVVELNVGGEFHTTTLGTLRKFPGSKLAEMFSSLAKASTDAEGRFFIDRPSTYFRPILDYLRTGQVPTQHIPEVYREAQFYEIKPLVKLLEDMPQIFGEQVSRKQFLLQVPGYSENLELMVRLARAEAITARKSSVLVCLVETEEQDAYYSEVLCFLQDKKMFKSVVKFGPWKAVLDNSDLMHCLEMDIKAQGYKVFSKFYLTYPTKRNEFHFNIYSFTFTWW

SEQ ID NO: 12977 - protein, 225 aa, Artificial Sequence
  Description of Artificial Sequence: Synthetic coding sequence
MSTVVELNVGGEFHTTTLGTLRKFPGSKLAEMFSSLAKASTDAEGRFFIDRPSTYFRPILDYLRTGQVPTQHIPEVYREAQFYEIKPLVKLLEDMPQIFGEQVSRKQFLLQVPGYSENLELMVRLARAEAITARKSSVLVCLVETEEQDAYYSEVLCFLQDKKMFKSVVKFGPWKAVLDNSDLMHCLEMDIKAQGYKVFSKFYLTYPTKRNEFHFNIYSFTFTWW

SEQ ID NO: 12978 - protein, 286 aa, Artificial Sequence
  Description of Artificial Sequence: Synthetic coding sequence
DAQMPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRYVLSFLRTSKLLLPDDFKDFSLLYEEARYYQLQPMVRELERWQQEQEQRRRSRACDCLVVRVTPDLGERIALSGEKALIEEVFPETGDVMCNSVNAGWNQDPTHVIRFPLNGYCRLNSVQVLERLFQRGFSVAASCGGGVDSSQFSEYVLCREERRPQPTPTAVRIKQEPLD

SEQ ID NO: 12979 - protein, 283 aa, Artificial Sequence
  Description of Artificial Sequence: Synthetic coding sequence
MPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRYVLSFLRTSKLLLPDDFKDFSLLYEEARYYQLQPMVRELERWQQEQEQRRRSRACDCLVVRVTPDLGERIALSGEKALIEEVFPETGDVMCNSVNAGWNQDPTHVIRFPLNGYCRLNSVQVLERLFQRGFSVAASCGGGVDSSQFSEYVLCREERRPQPTPTAVRIKQEPLD

SEQ ID NO: 12980 - protein, 297 aa, Artificial Sequence
  Description of Artificial Sequence: Synthetic coding sequence
MQTPRPAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKGSRPHPLRPEAELAVRASPRPLARPQSCHPCCYKPEAPGCEAPDHLQGLGVPI

SEQ ID NO: 12981 - protein, 321 aa, Artificial Sequence
  Description of Artificial Sequence: Synthetic coding sequence
MQTPRPAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKAQSSQDPANLFSLPPLPPPPLPAGGSRPHPLRPEAELAVRASPRPLARPQSCHPCCYKPEAPGCEAPDHLQGLGVPI

SEQ ID NO: 12982 - protein, 63 aa, Artificial Sequence
  Description of Artificial Sequence: Synthetic coding sequence
MTSKVSCPPSVTLRCCGLWQVASPLNVSDLSDETGAYLIDRDPTYFGPILNFLRHGKLVLDKD

SEQ ID NO: 12983 - protein, 180 aa, Artificial Sequence
  Description of Artificial Sequence: Synthetic coding sequence
  MOD_RES (1)..(1): Any amino acid
XQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKVPVRTLSDLRLSLQ

SEQ ID NO: 12984 - protein, 426 aa, Artificial Sequence
  Description of Artificial Sequence: Synthetic coding sequence
MEGHKAEEEVLDVLRLNVGGCIYTARRESLCRFKDSMLASMFSGRFPLKTDESGACVIDRDGRLFKYLLDYLHGEVQIPTDEQTRIALQEEADYFGIPYPYSLSDHLANEMETYSLRSNIELKKALTDFCDSYGLVCNKPTVWVLHYLNTSGASCESRIIGVYATKTDGTDAIEKQLGGRIHSKGIFKREAGNNVQYIWSYYSVAELKKMMDAFDAWEGKGVSYWRVPHELIECWTLEERPLLGSLRHMAPIRKRRLITFNEADESVNYKTGPKPVRFLGPSTSTQIKVKNSASVTVSPASAIQTSAGATANRFQSGSRRKAAQRSAPSRATALVGTGAPGHPQASPGAASAENGGTHLPPAKVLLSDKKPTPQRVIKLKRTPLCATAPCLPSPTATRQANSLKPLPGEAARALGVRTENGKNKGN

SEQ ID NO: 12985 - protein, 426 aa, Artificial Sequence; identical to SEQ ID NO: 12984
  Description of Artificial Sequence: Synthetic coding sequence

SEQ ID NO: 12986 - protein, 926 aa, Artificial Sequence
  Description of Artificial Sequence: Synthetic coding sequence
MEESGMAHESAEDLFHFNVGGWHFSVPRSKLSQFPDSLLWKEASALTSSESQRLFIDRDGSTFRHVHYYLYTSKLSFSSCAELNLLYEQALGLQLMPLLQTLDNLKEGKHHLRVRPADLPVAERASLNYWRTWKCISKPSEFPIKSPAFTGLHDKAPLGLMDTPLLDTEEEVHYCFLPLDLVAKYPSLVTEDNLLWLAETVALIECECSEFRFIVNFLRSQKILLPDNFSNIDVLEAEVEILEIPALTEAVRWYRMNMGGCSPTTCSPLSPGKGARTASLESVKPLYTMALGLLVKYPDSALGQLRIESTLDGSRLYITGNGVLFQHVKNWLGTCRLPLTETISEVYELCAFLDKRDITYEPIKVALKTHLEPRTLAPMDVLNEWTAEITVYSPQQIIKVYVGSHWYATTLQTLLKYPELLSNPQRVYWITYGQTLLIHGDGQMFRHILNFLRLGKLFLPSEFKEWPLFCQEVEEYHIPSLSEALAQCEAYKSWTQEKESENEEAFSIRRLHVVTEGPGSLVEFSRDTKETTAYMPVDFEDCSDRTPWNKAKGNLVRSNQMDEAEQYTRPIQVSLCRNAKRAGNPSTYSHCRGLCTNPGHWGSHPESPPKKKCTTINLTQKSETKDPPATPMQKLISLVREWDMVNCKQWEFQPLTATRSSPLEEATLQLPLGSEAASQPSTSAAWKAHSTASEKDPGPQAGAGAGAKDKGPEPTFKPYLPPKRAGTLKDWSKQRTKERESPAPEQPLPEASEVDSLGVILKVTHPPVVGSDGFCMFFEDSIIYTTEMDNLRHTTPTASPQPQEVTFLSFSLSWEEMFYAQKCHCFLADIIMDSIRQKDPKAITAKVVSLANRLWTLHISPKQFVVDLLAITGFKDDRHTQERLYSWVELTLPFARKYGRCMDLLIQRGLSRSVSYSILGKYLQED

SEQ ID NO: 12987 - protein, 419 aa, Artificial Sequence
  Description of Artificial Sequence: Synthetic coding sequence
MNVHRGSDSDRLLRQEASCLVDDTLAVAQEKEANSLASSGPHNLTYPLGPRNEDLSLDYASQPANLQFPHIMPLAEDIKGSCFQSGNKRNHEPFIAPERFGNSSVGFGSNSHSQAPEKVTLLVDGTRFVVNPQIFTAHPDTMLGRMFGPGREYNFTRPNEKGEYEIAEGISATVFRTVLDYYKTGIINCPDGISIPDLRDTCDYLCINFDFNTIRCQDLSALLHELSNDGAHKQFDHYLEELILPIMVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 12988 - protein, 253 aa, Artificial Sequence
  Description of Artificial Sequence: Synthetic coding sequence
MNVHRGSDSDRLLRQEASCLVDDTLAVAQEKEANSLASSGPHNLTYPLGPRNEGALLHELSNDGAHKQFDHYLEELILPIMVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 12989 - protein, 87 aa, Artificial Sequence
  Description of Artificial Sequence: Synthetic coding sequence
MNVHRGSDSDRLLRQEASCLVDDTLAVAQEKEANSLASSGPHNLTYPLGPRNEDLSLDYASQPANLQFPHIMPLAEDIKGSCFQSGN

SEQ ID NO: 12990 - protein, 109 aa, Artificial Sequence
  Description of Artificial Sequence: Synthetic coding sequence
MNVHRGSDSDRLLRQEASCLVDDTLAVAQEKEANSLASSGPHNLTYPLGPRNEDLSLDYASQPANLQFPHIMPLAEDIKGSCFQSGNKRNHEPFIAPERFGNSSVGFGS

SEQ ID NO: 12991 - protein, 97 aa, Artificial Sequence
  Description of Artificial Sequence: Synthetic coding sequence
MNVHRGSDSDRLLRQEASCLVDDTLAVAQEKEANSLASSGPHNLTYPLGPRNEDLSLDYASQPANLQFPHIMPLAEDIKGSCFQSGNKRNHEPFIAP

SEQ ID NO: 12992 - protein, 274 aa, Artificial Sequence
  Description of Artificial Sequence: Synthetic coding sequence
MFGPGREYNFTRPNEKGEYEIAEGISATVFRTVLDYYKTGIINCPDGISIPDLRDTCDYLCINFDFNTIRCQDLSALLHELSNDGAHKQFDHYLEELILPIMVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 12993 - protein, 173 aa, Artificial Sequence
  Description of Artificial Sequence: Synthetic coding sequence
MVGCAKKGERECHIVVLTDEDSVDWDEDHPPPMGEEYSQILYSSKLYRFFKYIENRDVAKTVLKERGLKNIRIGIEGYPTCKEKIKRRPGGRSEVIYNYVQRPFIQMSWEKEEGKSRHVDFQCVRSKSLTNLVAAGDDVLEDQEILMHHPPQVDELDRLNAPLSQMASNDFQD

SEQ ID NO: 12994 - protein, 260 aa, Artificial Sequence
  Description of Artificial Sequence: Synthetic coding sequence
MSDPITLNVGGKLYTTSLATLTSFPDSMLGAMFSGKMPTKRDSQGNCFIDRDGKVFRYILNFLRTSHLDLPEDFQEMGLLRREADFYQVQPLIEALQEKEVELSKAEKNAMLNITLNQRVQTVHFTVREAPQIYSLSSSSMEVFNANIFSTSCLFLKLLGSKLFYCSNGNLSSITSHLQDPNHLTLDWVANVEGLPEEEYTKQNLKRLWVVPANKQINSFQVFVEEVLKIALSDGFCIDSSHPHALDFMNNKIIRLIRYR

SEQ ID NO: 12995 - protein, 140 aa, Artificial Sequence
  Description of Artificial Sequence: Synthetic coding sequence
MSDPITLNVGGKLYTTSLATLTSFPDSMLGAMFSGKMPTKRDSQGNCFIDRDGKVFRYILNFLRTSHLDLPEDFQEMGLLRREADFYQVQPLIEALQEKEVELSKAEKNAMLNITLNQRVQTVHFTVREAPQIYSLSSSS

SEQ ID NO: 12996 - protein, 259 aa, Artificial Sequence
  Description of Artificial Sequence: Synthetic coding sequence
MERKINRREKEKEYEGKHNSLEDTDQGKNCKSTLMTLNVGGYLYITQKQTLTKYPDTFLEGIVNGKILCPFDADGHYFIDRDGLLFRHVLNFLRNGELLLPEGFRENQLLAQEAEFFQLKGLAEEVKSRWEKEQLTPRETTFLEITDNHDRSQGLRIFCNAPDFISKIKSRIVLVSKSRLDGFPEEFSISSNIIQFKYFIKSENGTRLVLKEDNTFVCTLETLKFEAIMMALKCGFRLLTSLDCSKGSIVHSDALHFIK

SEQ ID NO: 12997 - protein, 259 aa, Artificial Sequence; identical to SEQ ID NO: 12996
  Description of Artificial Sequence: Synthetic coding sequence

SEQ ID NO: 12998 - protein, 234 aa, Artificial Sequence
  Description of Artificial Sequence: Synthetic coding sequence
MAENHCELLSPARGGIGAGLGGGLCRRCSAGLGALAQRPGSVSKWVRLNVGGTYFLTTRQTLCRDPKSFLYRLCQADPDLDSDKDETGAYLIDRDPTYFGPVLNYLRHGKLVINKDLAEEGVLEEAEFYNITSLIKLVKDKIRERDSKTSQVPVKHVYRVLQCQEEELTQMVSTMSDGWKFEQLVSIGSSYNYGNEDQAEFLCVVSKELHNTPYGTASEPSEKAKILQERGSRM

SEQ ID NO: 12999 - protein, 237 aa, Artificial Sequence
  Description of Artificial Sequence: Synthetic coding sequence
MDNGDWGYMMTDPVTLNVGGHLYTTSLTTLTRYPDSMLGAMFGGDFPTARDPQGNYFIDRDGPLFRYVLNFLRTSELTLPLDFKEFDLLRKEADFYQIEPLIQCLNDPKPLYPMDTFEEVVELSSTRKLSKYSNPVAVIITQLTITTKVHSLLEGISNYFTKWNKHMMDTRDCQVSFTFGPCDYHQEVSLRVHLMEYITKQGFTIRNTRVHHMSERANENTVEHNWTFCRLARKTDD

SEQ ID NO: 13000 - protein, 237 aa, Artificial Sequence; identical to SEQ ID NO: 12999
  Description of Artificial Sequence: Synthetic coding sequence

SEQ ID NO: 13001 - protein, 9 aa, Artificial Sequence
  Description of Artificial Sequence: Synthetic coding sequence
MDNGDWGYM

SEQ ID NO: 13002 - protein, 237 aa, Artificial Sequence; identical to SEQ ID NO: 12999
  Description of Artificial Sequence: Synthetic coding sequence

SEQ ID NO: 13003 - protein, 473 aa, Artificial Sequence
  Description of Artificial Sequence: Synthetic coding sequence
MALKDTGSGGSTILPISEMVSSSSSPGASAAAAPGPCAPSPFPEVVELNVGGQVYVTKHSTLLSVPDSTLASMFSPSSPRGGARRRGELPRDSRARFFIDRDGFLFRYVLDYLRDKQLALPEHFPEKERLLREAEYFQLTDLVKLLSPKVTKQNSLNDEGCQSDLEDNVSQGSSDALLLRGAAAAVPSGPGAHGGGGGGGAQDKRSGFLTLGYRGSYTTVRDNQADAKFRRVARIMVCGRIALAKEVFGDTLNESRDPDRQPEKYTSRFYLKFTYLEQAFDRLSEAGFHMVACNSSGTAAFVNQYRDDKIWSSYTEYIFFRPPQKIVSPKQEHEDRKHDKVTDKGSESGTSCNELSTSSCDSHSEASTPQDNPSSAQQATAHQPNTLTLDRPSKKAPVQWIPPPDKRRNSELFQTLISKSRETNLSKKKVCEKLSVEEEMKKCIQDFKKIHIPDYFPERKRQWQSELLQKYGL

SEQ ID NO: 13004 - protein, 389 aa, Artificial Sequence
  Description of Artificial Sequence: Synthetic coding sequence
MRRVTLFLNGSPKNGKVVAVYGTLSDLLSVASSKLGIKATSVYNGKGGLIDDIALIRDDDVLFVCEGEPFIDPQTDSKPPEGLLGFHTDWLTLNVGGRYFTTTRSTLVNKEPDSMLAHMFKDKGVWGNKQDHRGAFLIDRSPEYFEPILNYLRHGQLIVNDGINLLGVLEEARFFGIDSLIEHLEVAIKNSQPPEDHSPISRKEFVRFLLATPTKSELRCQGLNFSGADLSRLDLRYINFKMANLSRCNLAHANLCCANLERADLSGSVLDCANLQGVKMLCSNAEGASLKLCNFEDPSGLKANLEGANLKGVDMEGSQMTGINLRVATLKNAKLKNCNLRGATLAGTDLENCDLSGCDLQEANLRGSNVKGAIFEEMLTPLHMSQSVR

SEQ ID NO: 13005 - protein, 560 aa, Artificial Sequence
  Description of Artificial Sequence: Synthetic coding sequence
AGPRAACSEPNPCTQVVMNSHSYNGSVGRPLGSGPGALGRDPPDPEAGHPPQPPHSPGLQVVVAKSEPARPSPGSPRGQPQDQDDDEDDEEDEAGRQRASGKPSNVGHRLGHRRALFEKRKRLSDYALIFGMFGIVVMVTETELSWGVYTKESLYSFALKCLISLSTAILLGLVVLYHAREIQLFMVDNGADDWRIAMTCERVFLISLELAVCAIHPVPGHYRFTWTARLAFTYAPSVAEADVDVLLSIPMFLRLYLLGRVMLLHSKIFTDASSRSIGALNKITFNTRFVMKTLMTICPGTVLLVFSISSWIIAAWTVRVCERYHDKQEVTSNFLGAMWLISITFLSIGYGDMVPHTYCGKGVCLLTGIMGAGCTALVVAVVARKLELTKAEKHVHNFMMDTQLTKRVKNAAANVLRETWLIYKHTRLVKKPDQARVRKHQRKFLQAIHHGRMLRSVKIEQGKLNDQANTLTDLAKTQTVMYDLVSELHAQHEELEARLATLESRLDALGASLQALPGLIAQAIRPPPPPLPPRPGPGPQDQAARSSPCRWTPVAPSDCG

SEQ ID NO: 13006 - protein, 409 aa, Artificial Sequence [sequence omitted]

SEQ ID NO: 13007 - protein, 436 aa, Artificial Sequence
  Description of Artificial Sequence: Synthetic coding sequence
MGLARALRRLSGALDSGDSRAGDEEEAGPGLCRNGWAPAPVQSPVGRRRGRFVKKDGHCNVRFVNLGGQGARYLSDLFTTCVDVRWRWMCLLFSCSFLASWLLFGLAFWLIASLHGDLAAPPPPAPCFSHVASFLAAFLFALETQTSIGYGVRSVTEECPAAVAAVVLQCIAGCVLDAFVVGAVMAKMAKPKKRNETLVFSENAVVALRDHRLCLMWRVGNLRRSHLVEAHVRAQLLQPRVTPEGEYIPLDHQDVDVGFDGGTDRIFLVSPITIVHEIDSASPLYELGRAELARADFELVVILEGMVEATAMTTQCRSSYLPGELLWGHRFEPVLFQRGSQYEVDYRHFHRTYEVPGTPVCSAKELDERAEQASHSLKSSFPGSLTAFCYENELALSCCQEEDEDDETEEGNGVETEDGAASPRVLTPTLALTLPP

SEQ ID NO: 13008 - protein, 436 aa, Artificial Sequence; identical to SEQ ID NO: 13007
  Description of Artificial Sequence: Synthetic coding sequence

SEQ ID NO: 13009 - protein, 393 aa, Artificial Sequence
  Description of Artificial Sequence: Synthetic coding sequence
MAQENAAFSPGQEEPPRRRGRQRYVEKDGRCNVQQGNVRETYRYLTDLFTTLVDLQWRLSLLFFVLAYALTWLFFGAIWWLIAYGRGDLEHLEDTAWTPCVNNLNGFVAAFLFSIETETTIGYGHRVITDQCPEGIVLLLLQAILGSMVNAFMVGCMFVKISQPNKRAATLVFSSHAVVSLRDGRLCLMFRVGDLRSSHIVEASIRAKLIRSRQTLEGEFIPLHQTDLSVGFDTGDDRLFLVSPLVISHEIDAASPFWEASRRALERDDFEIVVILEGMVEATGMTCQARSSYLVDEVLWGHRFTSVLTLEDGFYEVDYASFHETFEVPTPSCSARELAEAAARLDAHLYWSIPSRLDEKVEEEGAGEGAGGEAGADKEQNGCLPPPESESKV

SEQ ID NO: 13010 - protein, 235 aa, Artificial Sequence
  Description of Artificial Sequence: Synthetic coding sequence
MFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKSVILTKLYSSNVLFHSLFWPTCMMAGGVAIVAMVKLTQYLSLLCERIQRINR

SEQ ID NO: 13011 - protein, 235 aa, Artificial Sequence; identical to SEQ ID NO: 13010
  Description of Artificial Sequence: Synthetic coding sequence

SEQ ID NO: 13012 - protein, 235 aa, Artificial Sequence; identical to SEQ ID NO: 13010
  Description of Artificial Sequence: Synthetic coding sequence

SEQ ID NO: 13013 - protein, 137 aa, Artificial Sequence
  Description of Artificial Sequence: Synthetic coding sequence
MFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFSCGPDCWKLSQYPCLQVYVNLTSSGEKLLLYHTEETIK

SEQ ID NO: 13014 - protein, 235 aa, Artificial Sequence; identical to SEQ ID NO: 13010
  Description of Artificial Sequence: Synthetic coding sequence

SEQ ID NO: 13015 - protein, 100 aa, Artificial Sequence
  Description of Artificial Sequence: Synthetic coding sequence
MFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFS

SEQ ID NO: 13016 - protein, 216 aa, Artificial Sequence
  Description of Artificial Sequence: Synthetic coding sequence
MFIWTSGRTSSSYRHDEKRNIYQKIRDHDLLGLAMMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKSVILTKLYSSNVLFHSLFWPTCMMAGGVAIVAMVKLTQYLSLLCERIQRINR

SEQ ID NO: 13017 - protein, 905 aa, Artificial Sequence
  Description of Artificial Sequence: Synthetic coding sequence
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACICSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 13018 - protein, 994 aa, Artificial Sequence
  Description of Artificial Sequence: Synthetic coding sequence
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSGSPHELGPQFPSKGYSLLGPGSQNSMGAGPCAPGHPDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 13019 - protein, 526 aa, Artificial Sequence
  Description of Artificial Sequence: Synthetic coding sequence
MLMLLVRGTHYENLRSKVVLPTPLGGRSTETFVSEFPGPDTGIRWRRSDEALRVNVGGVRRQLSARALARFPGTRLGRLQAAASEEQARRLCDDYDEAAREFYFDRHPGFFLSLLHFYRTGHLHVLDELCVFAFGQEADYWGLGENALAACCRARYLERRLTQPHAWDEDSDTPSSVDPCPDEISDVQRELARYGAARCGRLRRRLWLTMENPGYSLPSKLFSCVSISVVLASIAAMCIHSLPEYQAREAAAAVAAVAAGRSPEGVRDDPVLRRLEYFCIAWFSFEVSSRLLLAPSTRNFFCHPLNLIDIVSVLPFYLTLLAGVALGDQGGKEFGHLGKVVQVFRLMRIFRVLKLARHSTGLRSLGATLKHSYREVGILLLYLAVGVSVFSGVAYTAEKEEDVGFNTIPACWWWGTVSMTTVGYGDVVPVTVAGKLAASGCILGGILVVALPITIIFNKFSHFYRRQKALEAAVRNSNHQEFEDLLSSIDGVSEASLETSRETSQEGQSADLESQAPSEPPHPQMY

SEQ ID NO: 13020 - protein, 526 aa, Artificial Sequence; identical to SEQ ID NO: 13019
  Description of Artificial Sequence: Synthetic coding sequence

SEQ ID NO: 13021 - protein, 499 aa, Artificial Sequence
  Description of Artificial Sequence: Synthetic coding sequence
MTVATGDPADEAAALPGHPQDTYDPEADHECCERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEADERESQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 13022 - protein, 356 aa, Artificial Sequence
  Description of Artificial Sequence: Synthetic coding sequence
MTVATGDPADEAAALPGHPQDTYDPEADHECCERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLERRPLQSQKSKRGRQHLNTSHDCTLGINLVAGMTVQWTRASGPDDRQTPAVTTLHRMY

SEQ ID NO: 13023 - protein, 499 aa, Artificial Sequence; identical to SEQ ID NO: 13021
  Description of Artificial Sequence: Synthetic coding sequence

SEQ ID NO: 13024 - protein, 499 aa, Artificial Sequence; identical to SEQ ID NO: 13021
  Description of Artificial Sequence: Synthetic coding sequence

SEQ ID NO: 13025 - protein, 529 aa, Artificial Sequence
  Description of Artificial Sequence: Synthetic coding sequence
MRSEKSLTLAAPGEVRGPEGEQQDAGDFPEAGGGGGCCSSERLVINISGLRFETQLRTLSLFPDTLLGDPGRRVRFFDPLRNEYFFDRNRPSFDAILYYYQSGGRLRRPVNVPLDIFLEEIRFYQLGDEALAAFREDEGCLPEGGEDEKPLPSQPFQRQVWLLFEYPESSGPARGIAIVSVLVILISIVIFCLETLPQFRVDGRGGNNGGVSRVSPVSRGSQEEEEDEDDSYTFHHGITPGEMGTGGSSSLSTLGGSFFTDPFFLVETLCIVWFTFELLVRFSACPSKPAFFRNIMNIIDLVAIFPYFITLGTELVQQQEQQPASGGGGQNGQQAMSLAILRVIRLVRVFRIFKLSRHSKGLQILGKTLQASMRELGLLIFFLFIGVILFSSAVYFAEADDDDSLFPSIPDAFWWAVVTMTTVGYGDMYPMTVGGKIVGSLCAIAGVLTIALPVPVIVSNFNYFYHRETEQEEQGQYTHVTCGQPAPDLRATDNGLGKPDFPEANRERRPSYLPTPHRAYAEKRMLTEV

SEQ ID NO: 13026 - protein, 529 aa, Artificial Sequence; identical to SEQ ID NO: 13025
  Description of Artificial Sequence: Synthetic coding sequence

SEQ ID NO: 13027 - protein, 647 aa, Artificial Sequence
  Description of Artificial Sequence: Synthetic coding sequence
MAAGLATWLPFARAAAVGWLPLAQQPLPPAPGVKASRGDEVLVVNVSGRRFETWKNTLDRYPDTLLGSSEKEFFYDADSGEYFFDRDPDMFRHVLNFYRTGRLHCPRQECIQAFDEELAFYGLVPELVGDCCLEEYRDRKKENAERLAEDEEAEQAGDGPALPAGSSLRQRLWRAFENPHTSTAALVFYYVTGFFIAVSVIANVVETIPCRGSARRSSREQPCGERFPQAFFCMDTACVLIFTGEYLLRLFAAPSRCRFLRSVMSLIDVVAILPYYIGLLVPKNDDVSGAFVTLRVFRVFRIFKFSRHSQGLRILGYTLKSCASELGFLLFSLTMAIIIFATVMFYAEKGTNKTNFTSIPAAFWYTIVTMTTLGYGDMVPSTIAGKIFGSICSLSGVLVIALPVPVIVSNFSRIYHQNQRADKRRAQQKVRLARIRLAKSGTTNAFLQYKQNGGLEDSGSGEEQALCVRNRSAFEQQHHHLLHCLEKTTCHEFTDELTFSEALGAVSPGGRTSRSTSVSSQPVGPGSLLSSCCPRRAKRRAIRLANSTASVSRGSMQELDMLAGLRRSHAPQSRSSLNAKPHDSLDLNCDSRDFVAAIISIPTPPANTPDESQPSSPGGGGRAGSTLRNSSLGTPCLFPETVKISSL

SEQ ID NO: 13028 - protein, 270 aa, Artificial Sequence
  Description of Artificial Sequence: Synthetic coding sequence
MVPSTIAGKIFGSICSLSGVLVIALPVPVIVSNFSRIYHQNQRADKRRAQQKVRLARIRLAKSGTTNAFLQYKQNGGLEDSGSGEEQALCVRNRSAFEQQHHHLLHCLEKTTCHEFTDELTFSEALGAVSPGGRTSRSTSVSSQPVGPGSLLSSCCPRRAKRRAIRLANSTASVSRGSMQELDMLAGLRRSHAPQSRSSLNAKPHDSLDLNCDSRDFVAAIISIPTPPANTPDESQPSSPGGGGRAGSTLRNSSLGTPCLFPETVKISSL

SEQ ID NO: 13029 - protein, 133 aa, Artificial Sequence
  Description of Artificial Sequence: Synthetic coding sequence
  MOD_RES (1)..(1): Any amino acid
XGRGLDRVGVSHNGEEGAALIALLHLLQDSGSGEEQALCVRNRSAFEQQHHHLLHCLEKTTCHEFTDELTFSEALGAVSPGGRTSRSTSVSSQPVGPGSLLSSCCPRRAKRRAIRLANSTASVSRGSMQELDM

SEQ ID NO: 13030 - protein, 466 aa, Artificial Sequence
  Description of Artificial Sequence: Synthetic coding sequence
MEPWPCSPGGGGGTRARHVIINVGGCRVRLAWAALARCPLARLERLRACRGHDDLLRVCDDYDVSRDEFFFDRSPCAFRAIVALLRAGKLRLLRGPCALAFRDELAYWGIDEARLERCCLRRLRRREEEAAEARAGPTERGAQGSPARALGPRGRLQRGRRRLRDVVDNPHSGLAGKLFACVSVSFVAVTAVGLCLSTMPDIRAEEERGECSPKCRSLFVLETVCVAWFSFEFLLRSLQAESKCAFLRAPLNIIDILALLPFYVSLLLGLAAGPGGTKLLERAGLVLRLLRALRVLYVMRLARHSLGLRSLGLTMRRCAREFGLLLLFLCVAMALFAPLVHLAERELGARRDFSSVPASYWWAVISMTTVGYGDMVPRSLPGQVVALSSILSGILLMAFPVTSIFHTFSRSYSELKEQQQRAASPEPALQEDSTHSATATEDSSQGPDSAGLADDSADALWVRAGR

SEQ ID NO: 13031 - protein, 1017 aa, Artificial Sequence
  Description of Artificial Sequence: Synthetic coding sequence
MPVMKGLLAPQNTFLDTIATRFDGTHSNFLLANAQGTRGFPIVYCSDGFCELTGYGRTEVMQKTCSCRFLYGPETSEPALQRLHKALEGHQEHRAEICFYRKDGSAFWCLLDMMPIKNEMGEVVLFLFSFKDITQSGSPGLGPQGGRGDSNHENSLGRRGATWKFRSARRRSRTVLHRLTGHFGRRGQGGMKANNNVFEPKPSVPEYKVASVGGSRCLLLHYSVSKAIWDGLILLATFYVAVTVPYNVCFSGDDDTPITSRHTLVSDIAVEMLFILDIILNFRTTYVSQSGQVISAPRSIGLHYLATWFFIDLIAALPFDLLYIFNITVTSLVHLLKTVRLLRLLRLLQKLERYSQCSAVVLTLLMSVFALLAHWMACIWYVIGRREMEANDPLLWDIGWLHELGKRLEVPYVNGSVGGPSRRSAYIAALYFTLSSLTSVGFGNVCANTDAEKIFSICTMLIGALMHAVVFGNVTAIIQRMYSRRSLYHSRMKDLKDFIRVHRLPRPLKQRMLEYFQTTWAVNSGIDANELLRDFPDELRADIAMHLNREILQLPLFGAASRGCLRALSLHIKTSFCAPGEYLLRRGDALQAHYYVCSGSLEVLRDNMVLAILGKGDLIGADIPEPGQEPGLGADPNFVLKTSADVKALTYCGLQQLSSRGLAEVLRLYPEYGAAFRAGLPRDLTFNLRQGSDTSGLSRFSRSPRLSQPRSESLGSSSDKTLPSITEAESGAEPGGGPRPRRPLLLPNLSPARPRGSLVSLLGEELPPFSALVSSPSLSPSLSPALAGQGHSASPHGPPRCSAAWKPPQLLIPPLGTFGPPDLSPRIVDGIEDSGSTAEAPSFRFSRRPELPRPRSQAPPTGTRPSPELASEAEEVKEKVCRLNQEISRLNQEVSQLSRELRHIMGLLQARLGPPGHPAGSAWTPDPPCPQLRPPCLSPCASRPPPSLQDTTLAEVHCPASVGTMETGTALLDLRPSILPPYPSEPDPLGPSPVPEASPPTPSLLRHSFQSRSDTFH

SEQ ID NO: 13032 - protein, 994 aa, Artificial Sequence; identical to SEQ ID NO: 13018
  Description of Artificial Sequence: Synthetic coding sequence

SEQ ID NO: 13033 - protein, 905 aa, Artificial Sequence; identical to SEQ ID NO: 13017
  Description of Artificial Sequence: Synthetic coding sequence

SEQ ID NO: 13034 - protein, 1107 aa, Artificial Sequence
  Description of Artificial Sequence: Synthetic coding sequence
MPVMKGLLAPQNTFLDTIATRFDGTHSNFILANAQVAKGFPIVYCSDGFCELAGFARTEVMQKSCSCKFLFGVETNEQLMLQIEKSLEEKTEFKGEIMFYKKNGSPFWCLLDIVPIKNEKGDVVLFLASFKDITDTKVKITPEDKKEDKVKGRSRAGTHFDSARRRSRAVLYHISGHLQRREKNKLKINNNVFVDKPAFPEYKVSDAKKSKFILLHFSTFKAGWDWLILLATFYVAVTVPYNVCFIGNDDLSTTRSTTVSDIAVEILFIIDIILNFRTTYVSKSGQVIFEARSICIHYVTTWFIIDLIAALPFDLLYAFNVTVVSLVHLLKTVRLLRLLRLLQKLDRYSQHSTIVLTLLMSMFALLAHWMACIWYVIGKMEREDNSLLKWEVGWLHELGKRLESPYYGNNTLGGPSIRSAYIAALYFTLSSLTSVGFGNVSANTDAEKIFSICTMLIGALMHALVFGNVTAIIQRMYSRWSLYHTRTKDLKDFIRVHHLPQQLKQRMLEYFQTTWSVNNGIDSNELLKDFPDELRSDITMHLNKEILQLSLFECASRGCLRSLSLHIKTSFCAPGEYLLRQGDALQAIYFVCSGSMEVLKDSMVLAILGKGDLIGANLSIKDQVIKTNADVKALTYCDLQCIILKGLFEVLDLYPEYAHKFVEDIQHDLTYNLREGHESDVISRLSNKSMVSQSEPKGNGNINKRLPSIVEDEEEEEEGEEEEAVSLSPICTRGSSSRNKKVGSNKAYLGLSLKQLASGTVPFHSPIRVSRSNSPKTKQEIDPPNHNKRKEKNLKLQLSTLNNAGPPDLSPRIVDGIEDGNSSEESQTFDFGSERIRSEPRISPPLGDPEIGAAVLFIKAEETKQQINKLNSEVTTLTQEVSQLGKDMRNVIQLLENVLSPQQPSRFCSLHSTSVCPSRESLQTRTSWSAHQPCLHLQTGGAAYTQAQLCSSNITSDIWSVDPSSVGSSPQRTGAHEQNPADSELYHSPSLDYSPSHYQVVQEGHLQFLRCISPHSDSTLTPLQSISATLSSSVCSSSETSLHLVLPSRSEEGSFSQGTVSSFSLENLPGSWNQEGMASASTKPLENLPLEVVTSTAEVKDNKAINV

SEQ ID NO: 13035 - protein, 185 aa, Artificial Sequence
  Description of Artificial Sequence: Synthetic coding sequence
MSMFALLAHWMACIWYVIGKMEREDNSLLKWEVGWLHELGKRLESPYYGNNTLGGPSIRSAYIAALYFTLSSLTSVGFGNVSANTDAEKIFSICTMLIGVSQFQVCPRPSWIICWFRNHFGFILLMTTLMHALVFGNVTAIIQRMYSRWSLYHTRTKDLKDFIRVHHLPQQLKQRMLEYFQTTCF

SEQ ID NO: 13036 - protein, 132 aa, Artificial Sequence
  Description of Artificial Sequence: Synthetic coding sequence
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTASRWCSCGPVVTPSRRPTSC

SEQ ID NO: 13037 - protein, 253 aa, Artificial Sequence
  Description of Artificial Sequence: Synthetic coding sequence
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 13038 - protein, 271 aa, Artificial Sequence
  Description of Artificial Sequence: Synthetic coding sequence
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTAADSKDEEVKVAPRRSFLDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 13039 - protein, 132 aa, Artificial Sequence; identical to SEQ ID NO: 13036
  Description of Artificial Sequence: Synthetic coding sequence

SEQ ID NO: 13040 - protein, 291 aa, Artificial Sequence
  Description of Artificial Sequence: Synthetic coding sequence
MVWKKLGSRNFSSCPSGSIQWIWDVLGECAQDGWDEASVGLGLISILCFAASTFPQFIKAYKTGNMDQALSLWFLLGWIGGDSCNLIGSFLADQLPLQTYTAVYYVLADLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNFLRKSTQGISYSLFALVMLGNTLYGLSVLLKNPEEGQSEGSYLLHHLPWLVGSLGVLLLDTIISIQFLVYRRSTAASELEPLLPS

SEQ ID NO: 13041 - protein, 291 aa, Artificial Sequence; identical to SEQ ID NO: 13040
  Description of Artificial Sequence: Synthetic coding sequence

SEQ ID NO: 13042 - protein, 226 aa, Artificial Sequence
  Description of Artificial Sequence: Synthetic coding sequence
MDQALSLWFLLGWIGGDSCNLIGSFLADQLPLQTYTAVYYVLADLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNFLRKSTQGISYSLFALVMLGNTLYGLSVLLKNPEEGQSEGSYLLHHLPWLVGSLGVLLLDTIISIQFLVYRRSTAASELEPLLPS

SEQ ID NO: 13043 - protein, 202 aa, Artificial Sequence
  Description of Artificial Sequence: Synthetic coding sequence
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCATRIITTLMTTNDFTILLRFVIMLALNIWVTVTVLRYRKTAIKAE

SEQ ID NO: 13044 - protein, 188 aa, Artificial Sequence
  Description of Artificial Sequence: Synthetic coding sequence
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCAILLRFVIMLALNIWVTVTVLRYRKTAIKAE

SEQ ID NO: 13045 - protein, 708 aa, Artificial Sequence
  Description of Artificial Sequence: Synthetic coding sequence
MSQYTEKEPAAMDQESGKAVWPKPAGGYQTITGRRYGRRHAYVSFKPCMTRHERSLGRAGDDYEVLELDDVPKENSSGSSPLDQVDSSLPSEPIFEKSETEIPTCGSALNQTTESSQSFVAVHHSEEGRDTLGSSTNLHNHSEGEYIPGACSASSVQNGIALVHTDSYDPDGKHGEDNDHLQLSAEVVEGSRYQESLGNTVFELENREAEAYTGLSPPVPSFNCEVRDEFEELDSVPLVKSSAGDTEFVHQNSQEIQRSSQDEMVSTKQQNNTSQERQTEHSPEDAACGPGHICSEQNTNDREKNHGSSPEQVVRPKVRKLISSSQVDQETGFNRHEAKQRSVQRWREALEVEESGSDDLLIKCEEYDGEHDCMFLDPPYSRVITQRETENNQMTSESGATAGRQEVDNTFWNGCGDYYQLYDKDEDSSECSDGEWSASLPHRFSGTEKDQSSSDESWETLPGKDENEPELQSDSSGPEEENQELSLQEGEQTSLEEGEIPWLQYNEVNESSSDEGNEPANEFAQPAFMLDGNNNLEDDSSVSEDLDVDWSLFDGFADGLGVAEAISYVDPQFLTYMALEERLAQAMETALAHLESLAVDVEVANPPASKESIDGLPETLVLEDHTAIGQEQCCPICCSEYIKDDIATELPCHHFFHKPCVSIWLQKSGTCPVCRRHFPPAVIEASAAPSSEPDPDAPPSNDSIAEAP

SEQ ID NO: 13046 - protein, 708 aa, Artificial Sequence; identical to SEQ ID NO: 13045
  Description of Artificial Sequence: Synthetic coding sequence

SEQ ID NO: 13047 - protein, 189 aa, Artificial Sequence
  Description of Artificial Sequence: Synthetic coding sequence
MGVSVDVHQVYKYPFEQVVASFLRKYPNPMDKNVISVKIMEEKRDESTGVIYRKRIAICQNVVPEILRKSLSTLVILCWKKVSILKVPNIQLEEESWLNPRERNMAIRSHCLTWTQYASMKEESVFRESMENPNWTEFIQRGRISITGVGFLNCVLETFASTFLRQGAQKGIRIMEMLLKEQCGAPLAE

SEQ ID NO: 13048 - protein, 177 aa, Artificial Sequence
  Description of Artificial Sequence: Synthetic coding sequence
MGVSVDVHQVYKYPFEQVVASFLRKYPNPMDKNVISVKIMEEKRDESTGVIYRKRIAICQNVVPEILRKVSILKVPNIQLEEESWLNPRERNMAIRSHCLTWTQYASMKEESVFRESMENPNWTEFIQRGRISITGVGFLNCVLETFASTFLRQGAQKGIRIMEMLLKEQCGAPLAE

SEQ ID NO: 13049 - protein, 148 aa, Artificial Sequence
  Description of Artificial Sequence: Synthetic coding sequence
MDKNVISVKIMEEKRDESTGVIYRKRIAICQNVVPEILRKVSILKVPNIQLEEESWLNPRERNMAIRSHCLTWTQYASMKEESVFRESMENPNWTEFIQRGRISITGVGFLNCVLETFASTFLRQGAQKGIRIMEMLLKEQCGAPLAE

SEQ ID NO: 13050 - protein, 88 aa, Artificial Sequence
  Description of Artificial Sequence: Synthetic coding sequence
MHQKLLKSAHYIELGSYQYWPVLVPRGIRLYTYEQIPGSLKDNPYITDGYRAYLPSRLCIKRSVCFALWAIIFFPAIGQKKHVEDGWH

SEQ ID NO: 13051 - protein, 291 aa, Artificial Sequence
  Description of Artificial Sequence: Synthetic coding sequence
MHQKLLKSAHYIELGSYQYWPVLVPRGIRLYTYEQIPGSLKDNPYITDGYRAYLPSRLCIKSLFILSNETVNIWSHLLGFFLFFTLGIYDMTSVLPSASASREDFVICSICLFCFQVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPENIFRWKITKRTLGGVNNSLQNLYLLV

SEQ ID NO: 13052 - protein, 311 aa, Artificial Sequence
  Description of Artificial Sequence: Synthetic coding sequence
MHQKLLKSAHYIELGSYQYWPVLVPRGIRLYTYEQIPGSLKDNPYITDGYRAYLPSRLCIKSLFILSNETVNIWSHLLGFFLFFTLGIYDMTSVLPSASASREDFVICSICLFCFQVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPGQLNYLGSSHQIWHILAVVMLYWWHQSTVYVMQYRHSKPCPDYVSHL

SEQ ID NO: 13053 - protein, 311 aa, Artificial Sequence; identical to SEQ ID NO: 13052
  Description of Artificial Sequence: Synthetic coding sequence

SEQ ID NO: 13054 - protein, 199 aa, Artificial Sequence
  Description of Artificial Sequence: Synthetic coding sequence
MAFLAGPRLLDWASSPPHLQFNKFVLTGYRPASSGSGCLRSLFYLHNELGNIYTHGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 13055 - protein, 273 aa, Artificial Sequence
  Description of Artificial Sequence: Synthetic coding sequence
MAFLAGPRLLDWASSPPHLQFNKFVLTGYRPASSGSGCLRSLFYLHNELGNIYTHGLALLGFLVLVPMTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 13056 - protein, 377 aa, Artificial Sequence
  Description of Artificial Sequence: Synthetic coding sequence
MPRRLQPRGAGTKGPPAPAPAASGAARNSHSAASRDPPASAKPLLRWDEVPDDFVECFILSGYRRLPCTAQECLASVLKPTNETLNFWTHFIPLLLFLSKFCRLFFLSGGDVPFHHPWLLPLWCYASGVLLTFAMSCTAHVFSCLSLRLRAAFFYLDYASISYYGFGSTVAYYYYLLPGLSLLDARVMTPYLQQRLGWHVDCTRLIAAYRALVLPVAFVLAVACTVACCKSRTDWCTYPFALRTFVFVMPLSMACPIMLESWLFDLRGENPTLFVHFYRRYFWLVVAAFFNVSKIPERIQPGLFDIIGHSHQLFHIFTFLSIYDQVYYVEEGLRQFLQAPPAAPTFSGTVGYMLLLVVCLGLVIRKFLNSSEFCSKK

SEQ ID NO: 13057 - protein, 330 aa, Artificial Sequence
  Description of Artificial Sequence: Synthetic coding sequence
MLSLKLPRLFSIDQIPQVFHEQGILFGYRHPQSSATACILSLFQMTNETLNIWTHLLPFWFFAWRFVTALYMTDIKNDSYSWPMLVYMCTSCVYPLVSSCAHTFSSMSKNARHICYFLDYGAVNLFSLGSAIAYSAYTFPDALMCTTFHDYYVALAVLNTILSTGLSCYSRFLEIQKPRLCKVIRVLAFAYPYTWDSLPIFYRLFLFPGESAQNEATSYHQKHMIMTLLASFLYSAHLPERLAPGRFDYIGHSHQLFHVCVILATHMQMEAILLDKTLRKEWLLATSKPFSFSQIAGAILLCIIFSLSNIIYFSAALYRIPKPELHKKET

SEQ ID NO: 13058 - protein, 330 aa, Artificial Sequence; identical to SEQ ID NO: 13057
  Description of Artificial Sequence: Synthetic coding sequence

SEQ ID NO: 13059 - protein, 330 aa, Artificial Sequence; identical to SEQ ID NO: 13057
  Description of Artificial Sequence: Synthetic coding sequence

SEQ ID NO: 13060 - protein, 344 aa, Artificial Sequence
  Description of Artificial Sequence: Synthetic coding sequence
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 13061 - protein, 351 aa, Artificial Sequence
  Description of Artificial Sequence: Synthetic coding sequence
MSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGEGTPGPAREEAGADAFPEHRMNWATATSYSTSVQCWAPTSSWRQCWLIWDHAEPGWPHRNLPWAWQAQWPHWSWLQLGTYSLLLLSQPPCFGPPVHALCCRVAHWRGVPRPNNSEAPSLTLSWRGQRPGPSADEEPRFGPNQVGTHLSLEPTGAEERGHRREGREEEGCLGGLAECERDREGALDGSGRSAEGLRGEMHACPG

SEQ ID NO: 13062 - protein, 363 aa, Artificial Sequence
  Description of Artificial Sequence: Synthetic coding sequence
TLPPSAWLAAALDSARGALGLLTHQLRSTHQALGVLGRWHHVWLPPPHQLGFGLCPQLLPDDQRDGQHLDSLPAHLVRGGSAPGRGLELRGGTQAGRDRPGPRAAAAVAGVRGGLSTRPPQVLPVAAPGAGGRPRLPCGAVPLAAAGLPAARLPLPLRVVLRAHLQLHVAPHAPHLLLPRLRRAQPLQSGFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 13063 - protein, 351 aa, Artificial Sequence; identical to SEQ ID NO: 13061
  Description of Artificial Sequence: Synthetic coding sequence

SEQ ID NO: 13064 - protein, 351 aa, Artificial Sequence; identical to SEQ ID NO: 13061
  Description of Artificial Sequence: Synthetic coding sequence

SEQ ID NO: 13065 - protein, 320 aa, Artificial Sequence
  Description of Artificial Sequence: Synthetic coding sequence
MSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 13066 - protein, 126 aa, Artificial Sequence
  Description of Artificial Sequence: Synthetic coding sequence
LPLPLRVVLRAHLQLHVAPHAPHLLLPRLRRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 13067 - protein, 341 aa, Artificial Sequence
  Description of Artificial Sequence: Synthetic coding sequence
MLSLKLPQLLQVHQVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 13068 - protein, 354 aa, Artificial Sequence
  Description of Artificial Sequence: Synthetic coding sequence
MTTAILERLSTLSVSGQQLRRLPKILEDGLPKMPCTVPETDVPQLFREPYIRTGYRPTGHEWRYYFFSLFQKHNEVVNVWTHLLAALAVLLRFWAFAEAEALPWASTHSLPLLLFILSSITYLTCSLLAHLLQSKSELSHYTFYFVDYVGVSVYQYGSALAHFFYSSDQAWYDRFWLFFLPAAAFCGWLSCAGCCYAKYRYRRPYPVMRKICQVVPAGLAFILDISPVAHRVALCHLAGCQEQAAWYHTLQILFFLVSAYFFSCPVPEKYFPGSCDIVGHGHQIFHAFLSICTLSQLEAILLDYQGRQEIFLQRHGPLSVHMACLSFFFLAACSAATAALLRHKVKARLTKKDS

SEQ ID NO: 13069 - protein, 354 aa, Artificial Sequence; identical to SEQ ID NO: 13068
  Description of Artificial Sequence: Synthetic coding sequence

SEQ ID NO: 13070 - protein, 112 aa, Artificial Sequence
  Description of Artificial Sequence: Synthetic coding sequence
MTTAILERLSTLSVSGQQLRRLPKILEDGLPKMPCTVPETDVPQLFREPYIRTGYRPTGHEWRYYFFSLFQKHNEVVNVWTHLLAALAVLLRFWAFAEAEALPWASTHSLPL

SEQ ID NO: 13071 - protein, 191 aa, Artificial Sequence
  Description of Artificial Sequence: Synthetic coding sequence
MAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 13072 - protein, 69 aa, Artificial Sequence
  Description of Artificial Sequence: Synthetic coding sequence
MAAYSYRPGPGAGPGPAAGAALPDQSFLWNVFQRVDKDRSGVISDTELQQALSNGTWTPFNPVTVRSII

SEQ ID NO: 13073 - protein, 73 aa, Artificial Sequence
  Description of Artificial Sequence: Synthetic coding sequence
MAAYSYRPGPGAGPGPAAGAALPDQSFLWNVFQRVDKDRSGVISDTELQQALSNGTWTPFNPVTVRSIICRGR

SEQ ID NO: 13074 - protein, 189 aa, Artificial Sequence
  Description of Artificial Sequence: Synthetic coding sequence
MAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGYRLSDQFHDILIRKFDRQGRGQIAFDDFIQGCIVLQRLTDIFRRYDTDQDGWIQVSYEQYLSMVFSIV

SEQ ID NO: 13075 - protein, 55 aa, Artificial Sequence
  Description of Artificial Sequence: Synthetic coding sequence
MAAYSYRPGPGAGPGPAAGAALPDQSFLWNVFQRVDKDRSGVISDTELQQALSNG

SEQ ID NO: 13076 - protein, 393 aa, Artificial Sequence
  Description of Artificial Sequence: Synthetic coding sequence
METTMGFMDDNATNTSTSFLSVLNPHGAHATSFPFNFSYSDYDMPLDEDEDVTNSRTFFAAKIVIGMALVGIMLVCGIGNFIFIAALVRYKKLRNLTNLLIANLAISDFLVAIVCCPFEMDYYVVRQLSWEHGHVLCTSVNYLRTVSLYVSTNALLAIAIDRYLAIVHPLRPRMKCQTATGLIALVWTVSILIAIPSAYFTTETVLVIVKSQEKIFCGQIWPVDQQLYYKSYFLFIFGIEFVGPVVTMTLCYARISRELWFKAVPGFQTEQIRKRLRCRRKTVLVLMCILTAYVLCWAPFYGFTIVRDFFPTVFVKEKHYLTAFYIVECIAMSNSMINTLCFVTVKNDTVKYFKKIMLLHWKASYNGGKSSADLDLKTIGMPATEEVDCIRLK

SEQ ID NO: 13077 - protein, 393 aa, Artificial Sequence; identical to SEQ ID NO: 13076
  Description of Artificial Sequence: Synthetic coding sequence

SEQ ID NO: 13078 - protein, 370 aa, Artificial Sequence
  Description of Artificial Sequence: Synthetic coding sequence
MASSTTRGPRVSDLFSGLPPAVTTPANQSAEASAGNGSVAGADAPAVTPFQSLQLVHQLKGLIVLLYSVVVVVGLVGNCLLVLVIARVRRLHNVTNFLIGNLALSDVLMCTACVPLTLAYAFEPRGWVFGGGLCHLVFFLQPVTVYVSVFTLTTIAVDRYVVLVHPLRRRISLRLSAYAVLAIWALSAVLALPAAVHTYHVELKPHDVRLCEEFWGSQERQRQLYAWGLLLVTYLLPLLVILLSYVRVSVKLRNRVVPGCVTQSQADWDRARRRRTFCLLVVIVVVFAVCWLPLHVFNLLRDLDPHAIDPYAFGLVQLLCHWLAMSSACYNPFIYAWLHDSFREELRKLLVAWPRKIAPHGQNMTVSVVI

SEQ ID NO: 13079 - protein, 370 aa, Artificial Sequence; identical to SEQ ID NO: 13078
  Description of Artificial Sequence: Synthetic coding sequence

SEQ ID NO: 13080 - protein, 295 aa, Artificial Sequence
  Description of Artificial Sequence: Synthetic coding sequence
MPFPPMPPPPAPAPGAQAARQLPRRPCAAGDKKKRPPQRPEGLLSSSWPSATLKRPPARRGPGLDRTQPPAPPGVSPQALPSRARAPATCAPPRPAGSGHSPARTTYAATSAGTGTTAAGTSSGAGPCPDSAARFCLNLTPEAVLVIQKRHLEKQLLARPRRPFPSPSAEPRRLLAPCLPARAAGPRRGGPASDPDAPPTAGQGRRAPPPGAQLLHGGLQVPQLSPRPGALRPMLKVSLLNERHRYDDVEYEEEPEAVDEGLVRKCTEWLRGVESAAAARGRAGALDSRRHLSTL

SEQ ID NO: 13081 - protein, 117 aa, Artificial Sequence
  Description of Artificial Sequence: Synthetic coding sequence
MPFPPMPPPPAPAPGAQAARQLPRRPCAAGDKKKRPPQRPEGLLSSSWPSATLKRPPARRGPGLDRTQPPAPPGVSPQALPSRARAPATCAPPRPAGSGHSPARTTYAATSAGTGTT

SEQ ID NO: 13082 - protein, 295 aa, Artificial Sequence
  Description of Artificial Sequence: Synthetic coding sequence
MSSPVLSDLPRFQAARQALQLSSSSAWNSVQTAVINVFKGGGLQSNELYALNENIRRLLKSELGSFITDYFQNQLLAKGLFFVEEKIKLCEGENRIEVLAEVWDHFFTETLPTLQAIFYPVQSVHEPTGPSESYLQLEELVKQVVSPFLGISGDRSFSGPTYTLARRHSRVRPKVTVLNYASPITAVSRPLNEMVLTPLTEQEGEAYLEKCGSVRRHTVANAHSDIQLLAMATMMHSGLGEEASSENKCLLLPPSFPPPHRQCSSEPNITDNPDGLEEGARGSQEGSELNCASLS

SEQ ID NO: 13083 - protein, 368 aa, Artificial Sequence
  Description of Artificial Sequence: Synthetic coding sequence
MTRGFAPILPVEFHKMGSFRRPRPRFMSSPVLSDLPRFQAARQALQLSSSSAWNSVQTAVINVFKGGGLQSNELYALNENIRRLLKSELGSFITDYFQNQLLAKGLFFVEEKIKLCEGENRIEVLAEVWDHFFTETLPTLQAIFYPVQGQELTIRQISLLGFRDLVLLKVKLGDLLLLAQSKLPSSIVQMLLILQSVHEPTGPSESYLQLEELVKQVVSPFLGISGDRSFSGPTYTLARRHSRVRPKVTVLNYASPITAVSRPLNEMVLTPLTEQEGEAYLEKCGSVRRHTVANAHSDIQLLAMATMMHSGLGEEASSENKCLLLPPSFPPPHRQCSSEPNITDNPDGLEEGARGSQEGSELNCASLS

SEQ ID NO: 13084 - protein, 48 aa, Artificial Sequence
  Description of Artificial Sequence: Synthetic coding sequence
MTRGFAPILPVEFHKMGSFRRPRPRFMSSPVLSDLPRFQAARQALQLS

SEQ ID NO: 13085 - protein, 80 aa, Artificial Sequence
  Description of Artificial Sequence: Synthetic coding sequence
MTRGFAPILPVEFHKMGSFRRPRPRFMSSPVLSDLPRFQAARQALQLSSSSAWNSVQTAVINVFKGGGLQSNELYALNEN

SEQ ID NO: 13086 - protein, 63 aa, Artificial Sequence
  Description of Artificial Sequence: Synthetic coding sequence
MTRGFAPILPVEFHKMGSFRRPRPRFMSSPVLSDLPRFQAARQALQLSSSSAWNSVQTAVINV

SEQ ID NO: 13087 - protein, 76 aa, Artificial Sequence
  Description of Artificial Sequence: Synthetic coding sequence
MTRGFAPILPVEFHKMGSFRRPRPRFMSSPVLSDLPRFQAARQALQLSSSSAWNSVQTAVINVFKGGGLQSNELYA

SEQ ID NO: 13088 - protein, 47 aa, Artificial Sequence
  Description of Artificial Sequence: Synthetic coding sequence
MTRGFAPILPVEFHKMGSFRRPRPRFMSSPVLSDLPRFQAARQALQL

SEQ ID NO: 13089 - protein, 75 aa, Artificial Sequence
  Description of Artificial Sequence: Synthetic coding sequence
MTRGFAPILPVEFHKMGSFRRPRPRFMSSPVLSDLPRFQAARQALQLSSSSAWNSVQTAVINVFKGGGLQSNELY

SEQ ID NO: 13090 - protein, 49 aa, Artificial Sequence
  Description of Artificial Sequence: Synthetic coding sequence
MTRGFAPILPVEFHKMGSFRRPRPRFMSSPVLSDLPRFQAARQALQLSS

SEQ ID NO: 13091 - protein, 368 aa, Artificial Sequence; identical to SEQ ID NO: 13083
  Description of Artificial Sequence: Synthetic coding sequence

SEQ ID NO: 13092 - protein, 83 aa, Artificial Sequence
  Description of Artificial Sequence: Synthetic coding sequence
MTRGFAPILPVEFHKMGSFRRPRPRFMSSPVLSDLPRFQAARQALQLSSSSAWNSVQTAVINVFKGGGLQSNELYALNENIRR

SEQ ID NO: 13093 - protein, 205 aa, Artificial Sequence
  Description of Artificial Sequence: Synthetic coding sequence
MTRGFAPILPVEFHKMGSFRRPRPRFMSSPVLSDLPRFQAARQALQLSSSSAWNSVQTAVINVFKGGGLQSNELYALNENIRRLLKSELGSFITDYFQNQLLAKGLFFVEEKIKLCEGENRIEVLAEVWDHFFTETLPTLQAIFYPVQGQELTIRQISLLGFRDLVLLKVKLGDLLLLAQSKLPSSIVQMLLILQPGGTPGSGPR

SEQ ID NO: 13094 - protein, 274 aa, Artificial Sequence
  Description of Artificial Sequence: Synthetic coding sequence
MVMSQGTYTFLTCFAGFWLIWGLIVLLCCFCSFLRRRLKRRQEERLREQNLRALELEPLELEGSLAGSPPGLAPPQPPPHRSRLEAPAHAHSHPHVHVHPLLHHGPAQPHAHAHPHPHHHALPHPPPTHLSVPPRPWSYPRQAESDMSKPPCYEEAVLMAEPPPPYSEVLTDTRGLYRKIVTPFLSRRDSAEKQEQPPPSYKPLFLDRGYTSALHLPSAPRPAPPCPALCLQADRGRRVFPSWTDSELSSREPLEHGAWRLPVSIPLFGRTTAV

SEQ ID NO: 13095 - protein, 254 aa, Artificial Sequence
  Description of Artificial Sequence: Synthetic coding sequence
MVMSQGTYTFLTCFAGFWLIWGLIVLLCCFCSFLRRRLKRRQEERLREQNLRALELEPLELEGSLAGSPPGLAPPQPPPHRSRLEAPAHHAHAHPHPHHHALPHPPPTHLSVPPRPWSYPRQAESDMSKPPCYEEAVLMAEPPPPYSEVLTDTRGLYRKIVTPFLSRRDSAEKQEQPPPSYKPLFLDRGYTSALHLPSAPRPAPPCPALCLQADRGRRVFPSWTDSELSSREPLEHGAWRLPVSIPLFGRTTAV

SEQ ID NO: 13096 - protein, 274 aa, Artificial Sequence; identical to SEQ ID NO: 13094
  Description of Artificial Sequence: Synthetic coding sequence

SEQ ID NO: 13097 - protein, 178 aa, Artificial Sequence
  Description of Artificial Sequence: Synthetic coding sequence
MVMSQGTYTFLTCFAGFWLIWGLIVLLCCFCSFLRRRLKRRQEERLREQNLRALELEPLELEGSLAGSPPGLAPPQPPPHRSRLEAPAHAHSHPHVHVHPLLHHGPAQPHAHAHPHPHHHALPHPPPTHLSVPPRPWSYPRQAESDMSKPPCYEEAVLMAEPPPPYSEVLTDTRGLYR

SEQ ID NO: 13098 - protein, 274 aa, Artificial Sequence; identical to SEQ ID NO: 13094
  Description of Artificial Sequence: Synthetic coding sequence

SEQ ID NO: 13099 - protein, 445 aa, Artificial Sequence
  Description of Artificial Sequence: Synthetic coding sequence
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIAGMYKQRLPPRTV

SEQ ID NO: 13100 - protein, 464 aa, Artificial Sequence
  Description of Artificial Sequence: Synthetic coding sequence
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIANPQRAVAVHGLVEARNFPAPGDLVSLLLGTV

SEQ ID NO: 13101 - protein, 311 aa, Artificial Sequence
  Description of Artificial Sequence: Synthetic coding sequence
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGANR

SEQ ID NO: 13102 - protein, 418 aa, Artificial Sequence
  Description of Artificial Sequence: Synthetic coding sequence
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQVGFLLCFFIMLQRNLHYCFQNKNLFGFFVRNMFLILFQSFFF

SEQ ID NO: 13103 - protein, 445 aa, Artificial Sequence
  Description of Artificial Sequence: Synthetic coding sequence
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIAESPKSSGSPWLG

SEQ ID NO: 13104 - protein, 462 aa, Artificial Sequence
  Description of Artificial Sequence: Synthetic coding sequence
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIADDYFPRIPKEQWQSMAWLKLEIFLPLVTW

SEQ ID NO: 13105 - protein, 306 aa, Artificial Sequence
  Description of Artificial Sequence: Synthetic coding sequence
MSSEKSGLPDSVPHTSPPPYNAPQPPAEPPAPPPQAAPSSHHHHHHHYHQSGTATLPRLGAGGLASSAATAQRGPSSSATLPRPPHHAPPGPAAGAPPPGCATLPRMPPDPYLQETRFEGPLPPPPPAAAAPPPPAPAQTAQAPGFVVPTHAGTVGTLPLGGYVAPGYPLQLQPCTAYVPVYPVGTPYAGGTPGGTGVTSTLPPPPQGPGLALLEPRRPPHDYMPIAVLTTICCFWPTGIIAIFKAVQVRTALARGDMVSAEIASREARNFSFISLAVGIAAMVLCTILTVVIIIAAQHHENYWDP

SEQ ID NO: 13106 - protein, 225 aa, Artificial Sequence
  Description of Artificial Sequence: Synthetic coding sequence
MPGTQTPAPAEDPHSGCRDPVPARPQACHPKSQETRFEGPLPPPPPAAAAPPPPAPAQTAQAPGFVVPTHAGTVGTLPLGGYVAPGYPLQLQPCTAYVPVYPVGTPYAGGTPGGTGVTSTLPPPPQGPGLALLEPRRPPHDYMPIAVLTTICCFWPTGIIAIFKAVQVRTALARGDMVSAEIASREARNFSFISLAVGIAAMVLCTILTVVIIIAAQHHENYWDP

SEQ ID NO: 13107 - protein, 225 aa, Artificial Sequence; identical to SEQ ID NO: 13106
  Description of Artificial Sequence: Synthetic coding sequence

SEQ ID NO: 13108 - protein, 225 aa, Artificial Sequence; identical to SEQ ID NO: 13106
  Description of Artificial Sequence: Synthetic coding sequence

SEQ ID NO: 13109 - protein, 306 aa, Artificial Sequence; identical to SEQ ID NO: 13105
  Description of Artificial Sequence: Synthetic coding sequence

SEQ ID NO: 13110 - protein, 225 aa, Artificial Sequence; identical to SEQ ID NO: 13106
  Description of Artificial Sequence: Synthetic coding sequence

SEQ ID NO: 13111 - protein, 306 aa, Artificial Sequence; identical to SEQ ID NO: 13105
  Description of Artificial Sequence: Synthetic coding sequence

SEQ ID NO: 13112 - protein, 63 aa, Artificial Sequence
  Description of Artificial Sequence: Synthetic coding sequence
MPGTQTPAPAEDPHSGCRDPVPARPQACHPKSQETRFEGPLPPPPPAAAAPPPPAPAQTAQAP

SEQ ID NO: 13113 - protein, 63 aa, Artificial Sequence; identical to SEQ ID NO: 13112
  Description of Artificial Sequence: Synthetic coding sequence

SEQ ID NO: 13114 - protein, 225 aa, Artificial Sequence; identical to SEQ ID NO: 13106
  Description of Artificial Sequence: Synthetic coding sequence

SEQ ID NO: 13115 - protein, 63 aa, Artificial Sequence; identical to SEQ ID NO: 13112
  Description of Artificial Sequence: Synthetic coding sequence

SEQ ID NO: 13116 - protein, 225 aa, Artificial Sequence; identical to SEQ ID NO: 13106
  Description of Artificial Sequence: Synthetic coding sequence

SEQ ID NO: 13117 - protein, 63 aa, Artificial Sequence; identical to SEQ ID NO: 13112
  Description of Artificial Sequence: Synthetic coding sequence

SEQ ID NO: 13118 - protein, 63 aa, Artificial Sequence; identical to SEQ ID NO: 13112
  Description of Artificial Sequence: Synthetic coding sequence

SEQ ID NO: 13119 - protein, 63 aa, Artificial Sequence; identical to SEQ ID NO: 13112
  Description of Artificial Sequence: Synthetic coding sequence

SEQ ID NO: 13120 - protein, 225 aa, Artificial Sequence; identical to SEQ ID NO: 13106
  Description of Artificial Sequence: Synthetic coding sequence

SEQ ID NO: 13121 - protein, 63 aa, Artificial Sequence; identical to SEQ ID NO: 13112
  Description of Artificial Sequence: Synthetic coding sequence

SEQ ID NO: 13122 - protein, 306 aa, Artificial Sequence; identical to SEQ ID NO: 13105
  Description of Artificial Sequence: Synthetic coding sequence

SEQ ID NO: 13123 - protein, 225 aa, Artificial Sequence; identical to SEQ ID NO: 13106
  Description of Artificial Sequence: Synthetic coding sequence

SEQ ID NO: 13124 - protein, 306 aa, Artificial Sequence; identical to SEQ ID NO: 13105
  Description of Artificial Sequence: Synthetic coding sequence

SEQ ID NO: 13125 - protein, 225 aa, Artificial Sequence; identical to SEQ ID NO: 13106
  Description of Artificial Sequence: Synthetic coding sequence

SEQ ID NO: 13126 - protein, 306 aa, Artificial Sequence; identical to SEQ ID NO: 13105
  Description of Artificial Sequence: Synthetic coding sequence

SEQ ID NO: 13127 - protein, 306 aa, Artificial Sequence; identical to SEQ ID NO: 13105
  Description of Artificial Sequence: Synthetic coding sequence

SEQ ID NO: 13128 - protein, 63 aa, Artificial Sequence; identical to SEQ ID NO: 13112
  Description of Artificial Sequence: Synthetic coding sequence

SEQ ID NO: 13129 - protein, 306 aa, Artificial Sequence; identical to SEQ ID NO: 13105
  Description of Artificial Sequence: Synthetic coding sequence

SEQ ID NO: 13130 - protein, 225 aa, Artificial Sequence; identical to SEQ ID NO: 13106
  Description of Artificial Sequence: Synthetic coding sequence

SEQ ID NO: 13131 - protein, 225 aa, Artificial Sequence; identical to SEQ ID NO: 13106
  Description of Artificial Sequence: Synthetic coding sequence

SEQ ID NO: 13132 - protein, 225 aa, Artificial Sequence; identical to SEQ ID NO: 13106
  Description of Artificial Sequence: Synthetic coding sequence

SEQ ID NO: 13133 - protein, 225 aa, Artificial Sequence; identical to SEQ ID NO: 13106
  Description of Artificial Sequence: Synthetic coding sequence

SEQ ID NO: 13134 - protein, 225 aa, Artificial Sequence; identical to SEQ ID NO: 13106
  Description of Artificial Sequence: Synthetic coding sequence

SEQ ID NO: 13135 - protein, 225 aa, Artificial Sequence; identical to SEQ ID NO: 13106
  Description of Artificial Sequence: Synthetic coding sequence

SEQ ID NO: 13136 - protein, 225 aa, Artificial Sequence; identical to SEQ ID NO: 13106
  Description of Artificial Sequence: Synthetic coding sequence

SEQ ID NO: 13137 - protein, 981 aa, Artificial Sequence
  Description of Artificial Sequence: Synthetic coding sequence
MASSPWGCVCGLLLLLLPLLGTGPALGRGFPRPLENSEIPMIPGAHPKGSVGSEPQAFDVFPENPRADSHRNSDVRHAPAEEMPEKPVASPLGPALYGPKAAQGAQRERLPVTDDLQMAQGPSSHGWTGPLDSQELLQQEAVAPHPVGHPHLTFIPTTPRRQLRVATVPPSLQHEGQEGQWPPRDEGLKAKTKSRVPPTSPSDHQGPPHTLVSHSGTVKRPVLEGQGGFEEHLQEAAQGPHFTQQDPAAPDVGSVPPVEVVYSQEPGAQPDLALARSLPPAEELPVETPKRAGAEVSWEVSSPGPPPKQADLPDAKDSPGPQPTDPPASEAPDRPSKPERAAMNGADPISPQRVRGAVEAPGTPKSLIPGPSDPGPAVNRTESPMGALQPDEAEEWPGRPQSHPPAPPVQAPSTSRRGLIRVTTQRALGQPPPPEPTASSMASAPASSPPANATAPPLRWGPLRRVLSFSWELHVYGVGVLFLLPALLALAALAAAPAGPRLALVAAVLVLVASALRSAYMLTDPYGSQARLGVRGGLVLYNLPFPLLLTALAALTLLGLGAGLPPPLQNPLLLGAVALVHGVGLLATDLLSTWSVLNLLTQGLSCAWGAAVALGTLCLCRRRLLDGPRGWDASPGPRLLAVAGALGLLASGLQLAAALWLYPGPGRVGRFSWAWWGVHFWLRLLELTWALALALAAVAAARPRPPTEHACWAKLMRLACPAPSGKSEVPERPNNCYAGPSNVGAGSLDISKSLIRNPAESGQLATPSSGAWGSAASLGRGPQGGPGLSRNGVGPAPSLSELDLRPPSPINLSRSIDAALFREHLVRDSVFQRCGLRGLASPPPGGALRPRRGSHPKAELDDAGSSLLRGRCRSLSDVRVRGPVPQHVVEAPDGAAAAASGSSLDSFSRGSLKISWNPWRHGLSSVDSLPLDELPSTVQLLPAPTPAPDSTAARQGDGQGEVQPRGKPGESRSASSDTIEL

SEQ ID NO: 13138 - protein, 981 aa, Artificial Sequence; identical to SEQ ID NO: 13137
  Description of Artificial Sequence: Synthetic coding sequence

SEQ ID NO: 13139 - protein, 693 aa, Artificial Sequence
  Description of Artificial Sequence: Synthetic coding sequence
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGGYEVLHALGYGGQSGLEGPWPWWAFQLGLRLGEVGVALPLALLGLYPALCSPRVPPRCWAKLFRLSPGHAAPLLPGGWVTGPPDKEPLGSAIARGDAELLQLCALAGPGPDLLLQGGGCRGFEGAAANPAPSPASSPCSDYTVDFRPPSPINLRRSIEEALCSEALLAPGLFQGPAFEDALPGLGLYRTASLGTGGRASERSGEASGPAAPPELPSPGAWPAGSSVSSGSFCGLSRDSSSMLLCSSPDRPPRCPLVCVLSPPRPSGSSPSLPASGSYQALSPPSRDSPEPASELQAEEALLQEQFLDACRQIDELSVGSDTIDL

SEQ ID NO: 13140 - protein, 899 aa, Artificial Sequence
  Description of Artificial Sequence: Synthetic coding sequence
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGVGALFGLVALLALLALALLPWRCPPGAPCLALLDLLLLSAGTTRAFPLFYDAYGHRDRLPALAWLLLQDLPLPCLAAGLGLACLLLARPRPPRCPTGLAALLLLGLGLAAAAALGSAAHRPLRPLRLASRGLHAFLAAFLSGLLLALSCWGGRRRRAGAPLGGSGFKGATPLPQGRSPFAPRESWRRAARTAPVAGTFGLLSGALQGYEVLHALGYGGQSGLEGPWPWWAFQLGLRLGEVGVALPLALLGLYPALCSPRVPPRCWAKLFRLSPGHAAPLLPGGWVTGPPDKEPLGSAIARGDAELLQLCALAGPGPDLLLQGGGCRGFEGAAANPAPSPASSPCSDYTVDFRPPSPINLRRSIEEALCSEALLAPGLFQGPAFEDALPGLGLYRTASLGTGGRASERSGEASGPAAPPELPSPGAWPAGSSVSSGSFCGLSRDSSSMLLCSSPDRPPRCPLVCVLSPPRPSGSSPSLPASGSYQALSPPSRDSPEPASELQAEEALLQEQFLDACRQIDELSVGSDTIDL

SEQ ID NO: 13141 - protein, 899 aa, Artificial Sequence; identical to SEQ ID NO: 13140
  Description of Artificial Sequence: Synthetic coding sequence

SEQ ID NO: 13142 - protein, 429 aa, Artificial Sequence
  Description of Artificial Sequence: Synthetic coding sequence
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGRLHRGLPPALPNQPATQHRGGPLQRGPACAWPLPGPCLRGRSAWARTLPHRLAGDRGQGQ

SEQ ID NO: 13143 - protein, 563 aa, Artificial Sequence
  Description of Artificial Sequence: Synthetic coding sequence
MAAAAVTGQRPETAAAEEASRPQWAPPDHCQAQAAAGLGDGEDAPVRPLCKPRGICSRAYFLVLMVFVHLYLGNVLALLLFVHYSNGDESSDPGPQHRAQGPGPEPTLGPLTRLEGIKVGHERKVQLVTDRDHFIRTLSLKPLLFEIPGFLTDEECRLIIHLAQMKGLQRSQILPTEEYEEAMSTMQVSQLDLFRLLDQNRDGHLQLREVLAQTRLGNGWWMTPESIQEMYAAIKADPDGDGVLSLQEFSNMDLRDFHKYMRSHKAESSELVRNSHHTWLYQGEGAHHIMRAIRQRVLRLTRLSPEIVELSEPLQVVRYGEGGHYHAHVDSGPVYPETICSHTKLVANESVPFETSCRQVSPNWGLPSILRPGTPMTQAQPCTVGVPLGMGPGDHWVIPVSPWEHPQLGTCSVPPLPYSYMTVLFYLNNVTGGGETVFPVADNRTYDEMSLIQDDVDLRDTRRHCDKGNLRVKPQQGTAVFWYNYLPDGQGWVGDVDDYSLHGGCLVTRGTKWIANNWINVDPSRARQALFQQEMARLAREGGTDSQPEWALDRAYRDARVEL

SEQ ID NO: 13144 - protein, 502 aa, Artificial Sequence [sequence omitted]

SEQ ID NO: 13145 - protein, 785 aa, Artificial Sequence
  Description of Artificial Sequence: Synthetic coding sequence
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 13146 - protein, 113 aa, Artificial Sequence
  Description of Artificial Sequence: Synthetic coding sequence
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAI

SEQ ID NO: 13147 - protein, 92 aa, Artificial Sequence
  Description of Artificial Sequence: Synthetic coding sequence
MPKGRQKVPHLDAPLGLPTCLWLELAGLFLLVPWVMGLAGTGGPDGQGTGGPSWAVHLESLEGDGEEETLEQQADALAQAAGLVNAGRIGEL

SEQ ID NO: 13148 - protein, 92 aa, Artificial Sequence; identical to SEQ ID NO: 13147
  Description of Artificial Sequence: Synthetic coding sequence

SEQ ID NO: 13149 - protein, 237 aa, Artificial Sequence
  Description of Artificial Sequence: Synthetic coding sequence
MPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVG

SEQ ID NO: 13150 - protein, 591 aa, Artificial Sequence
  Description of Artificial Sequence: Synthetic coding sequence
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSWLCVECSRHQGQTKAVRECHEWKIPAR

SEQ ID NO: 13151 - protein, 673 aa, Artificial Sequence
  Description of Artificial Sequence: Synthetic coding sequence
MAKLETLPVRADPGRDPLLAFAPRPSELGPPDPRLAMGSVGSGVAHAQEFAMKSVGTRTGGGGSQGSFPGPRGSGSGASRERPGRYPSEDKGLANSLYLNGELRGSDHTDVCGNVVGSSGGSSSSGGSDKAPPQYREPSHPPKLLATSGKLDQCSEPLVRPSAFKPVVPKNFHSMQNLCPPQTNGTPEGRQGPGGLKGGLDKSRTMTPAGGSGSGLSDSGRNSLTSLPTYSSSYSQHLAPLSASTSHINRIGTASYGSGSGGSSGGGSGYQDLGTSDSGRASSKSGSSSSMGRPGHLGSGEGGGGGLPFAACSPPSPSALIQELEERLWEKEQEVAALRRSLEQSEAAVAQVLEERQKAWERELAELRQGCSGKLQQVARRAQRAQQGLQLQVLRLQQDKKQLQEEAARLMRQREELEDKVAACQKEQADFLPRIEETKWEVCQKAGEISLLKQQLKDSQADVSQKLSEIVGLRSQLREGRASLREKEEQLLSLRDSFSSKQASLELGEGELPAACLKPALTPVDPAEPQDALATCESDEAKMRRQAGVAAAASLVSVDGEAEAGGESGTRALRREVGRLQAELAAERRARERQGASFAEERRVWLEEKEKVIEYQKQLQLSYVEMYQRNQQLERRLRERGAAGGASTPTPQHGEEKKAWTPSRLERIESTEI

SEQ ID NO: 13152 - protein, 627 aa, Artificial Sequence
  Description of Artificial Sequence: Synthetic coding sequence
MAKLETLPVRADPGRDPLLAFAPRPSELGPPDPRLAMGSVGSGVAHAQEFAMKSVGTRTGGGGSQGSFPGPRGSGSGASRERPGRYPSEDKGLANSLYLNGELRGSDHTDVCGNVVGSSGGSSSSGGSDKAPPQYREPSHPPKLLATSGKLDQCSEPLVRPSAFKPVVPKNFHSMQNLCPPQTNGTPEGRQGPGGLKGGLDKSRTMTPAGGSGSGLSDSGRNSLTSLPTYSSSYSQHLAPLSASTSHINRIGTASYGSGSGGSSGGGSGYQDLGTSDSGRASSKSGSSSSMGRPGHLGSGEGGGGGLPFAACSPPSPSALIQELEERLWEKEQEVAALRRSLEQSEAAVAQQDKKQLQEEAARLMRQREELEDKVAACQKEQADFLPRIEETKWEVCQKAGEISLLKQQLKDSQADVSQKLSEIVGLRSQLREGRASLREKEEQLLSLRDSFSSKQASLELGEGELPAACLKPALTPVDPAEPQDALATCESDEAKMRRQAGVAAAASLVSVDGEAEAGGESGTRALRREVGRLQAELAAERRARERQGASFAEERRVWLEEKEKVIEYQKQLQLSYVEMYQRNQQLERRLRERGAAGGASTPTPQHGEEKKAWTPSRLERIESTEI

SEQ ID NO: 13153 - protein, 627 aa, Artificial Sequence; identical to SEQ ID NO: 13152
  Description of Artificial Sequence: Synthetic coding sequence

SEQ ID NO: 13154 - protein, 395 aa, Artificial Sequence
  Description of Artificial Sequence: Synthetic coding sequence
MSANATLKPLCPILEQMSRLQSHSNTSIRYIDHAAVLLHGLASLLGLVENGVILFVVGCRMRQTVVTTWVLHLALSDLLASASLPFFTYFLAVGHSWELGTTFCKLHSSIFFLNMFASGFLLSAISLDRCLQVVRPVWAQNHRTVAAAHKVCLVLWALAVLNTVPYFVFRDTISRLDGRIMCYYNVLLLNPGPDRDATCNSRQVALAVSKFLLAFLVPLAIIASSHAAVSLRLQHRGRRRPGRFVRLVAAVVAAFALCWGPYHVFSLLEARAHANPGLRPLVWRGLPFVTSLAFFNSVANPVLYVLTCPDMLRKLRRSLRTVLESVLVDDSELGGAGSSRRRRTSSTARSASPLALCSRPEEPRGPARLLGWLLGSCAASPQTGPLNRALSSTSS

SEQ ID NO: 13155 - protein, 310 aa, Artificial Sequence
  Description of Artificial Sequence: Synthetic coding sequence
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 13156 - protein, 374 aa, Artificial Sequence
  Description of Artificial Sequence: Synthetic coding sequence
MRSPAVPTPARGQLGVAFVLLPPHSEGARVFGALGPIGPSSPGLTLGGLAVSEHRLSNKLLAWSGVLEWQEKRRPYSDSTAKLKRTLPCQAYVNQGENLETDQWPQKLIMQLIPQQLLTTLGPLFRNSQLAQFHFTNRDCDSLKGLCRIMGNGFAGCMLFPHISPCEVRVLMLLYSSKKKIFMGLIPYDQSGFVSAIRQVITTRKQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFRRKSSLASSPMTRATLSTASGVSLPTSSRSCSGTWSRSNSNEGWGGSGYPGLGPSRSHR

SEQ ID NO: 13157 - protein, 416 aa, Artificial Sequence
  Description of Artificial Sequence: Synthetic coding sequence
MVRPRRAPYRSGAGGPLGGRGRPPRPLVVRAVRSRSWPASPRGPQPPRIRARSAPPMEGARVFGALGPIGPSSPGLTLGGLAVSEHRLSNKLLAWSGVLEWQEKRRPYSDSTAKLKRTLPCQAYVNQGENLETDQWPQKLIMQLIPQQLLTTLGPLFRNSQLAQFHFTNRDCDSLKGLCRIMGNGFAGCMLFPHISPCEVRVLMLLYSSKKKIFMGLIPYDQSGFVSAIRQVITTRKQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 13158 - protein, 276 aa, Artificial Sequence
  Description of Artificial Sequence: Synthetic coding sequence
MLLFSVLLLLSLVTGTQLGPRTPLPEAGVAILGRARGAHRPQPPHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKAPMVIMDWEECSKMFPKLTKNMLCAGYKNESYDACKQSYFPTLQRMNTGSSQTKPPGSHTFHLQN

SEQ ID NO: 13159 - protein, 352 aa, Artificial Sequence
  Description of Artificial Sequence: Synthetic coding sequence
MLLFSVLLLLSLVTGTQLGPRTPLPEAGVAILGRARGAHRPQPPHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKAPMVIMDWEECSKMFPKLTKNMLCAGYKNESYDACKGDSGGPLVCTPEPGEKWYQVGIISWGKSCGEKNTPGIYTSLVNYNLWIEKVTQLEGRPFNAEKRRTSVKQKPMGSPVSGVPEPGSPRSWLLLCPLSHVLFRAILY

SEQ ID NO: 13160 - protein, 394 aa, Artificial Sequence
  Description of Artificial Sequence: Synthetic coding sequence
MGMKHSSRCLLLRRKMAENAAESTEVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 13161 - protein, 385 aa, Artificial Sequence
  Description of Artificial Sequence: Synthetic coding sequence
MESLASDGFKLKEVSSVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 13162 - protein, 1165 aa, Artificial Sequence
  Description of Artificial Sequence: Synthetic coding sequence
MYFLSGWPKRLLCPLGSPAEAPFHVQSDPQRAFFAVLAAARLSIWYSRPSVLIVTYKEPAKSSTQFGSYKQAEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTGNVDFMSLVQGELYFTPCIYTFCY

SEQ ID NO: 13163 - protein, 680 aa, Artificial Sequence [sequence omitted]

SEQ ID NO: 13164 - protein, 75 aa, Artificial Sequence
  Description of Artificial Sequence: Synthetic coding sequence
MAAEWASRFWLWATLLIPAAAVYEDQVGKFDWRQQYVGKVKFASLEFSPGSKKLVVATEKNVIAALNSRTGEICE

SEQ ID NO: 13165 - protein, 554 aa, Artificial Sequence
  Description of Artificial Sequence: Synthetic coding sequence
APTGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWWHLGPWLPAVGTSWEALMALWV

SEQ ID NO: 13166 - protein, 218 aa, Artificial Sequence
  Description of Artificial Sequence: Synthetic coding sequence
QVKKVLFEDDERSTDSSQQCSSEDEDIFEETAQVSPPRGKEKRQWRARMPLLSVQPVSNADWVWLVKRLHKLCMELCNNYIQMHLDLENCMEEPPIFKGDPFFILPSFQSESSTPSTGGFSGKETPSEDDRSQPRSGSTGSSLSVSVRDAEAQIQAWTNMVLTVLNQIQILPDQTFTALQPAVFPCISQLTCHVTDIRVRQAVREWLGRVGRVYDIIV

SEQ ID NO: 13167 - protein, 344 aa, Artificial Sequence
  Description of Artificial Sequence: Synthetic coding sequence
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKAHSRPV

SEQ ID NO: 13168 - protein, 992 aa, Artificial Sequence
  Description of Artificial Sequence: Synthetic coding sequence
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 13169 - protein, 971 aa, Artificial Sequence
  Description of Artificial Sequence: Synthetic coding sequence
MAAEWASRFWLWATLLIPAAAVYEDQVGKFDWRQQYVGKVKFASLEFSPGSKKLVVATEKNVIAALNSRTGEIYVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 13170 - protein, 1366 aa, Artificial Sequence
  Description of Artificial Sequence: Synthetic coding sequence
MLFKQAELWMPHQGKGNKGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMQEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 13171 - protein, 667 aa, Artificial Sequence
  Description of Artificial Sequence: Synthetic coding sequence
MWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKVGAPGILQGMVLSFGGLQFTENHLQFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKVGSRHLVETRGLGLALSPVSRKGLAWRGGVRPGQEWVS

SEQ ID NO: 13172 - protein, 160 aa, Artificial Sequence
  Description of Artificial Sequence: Synthetic coding sequence
FLPDNFSPAKPKPSKDLKPLLGSAVLGLLLVLAAVVAWCYYSVSLRKAERLRAELLDLKAGGFSIRNQKGEQEPQPFVTSDVYSSDAAFGGILERYWLSSRAAAIKVNDSVPFHLGWNSTERSLRLQARYHDTPYKPPAGRAAAPELSYRVCVGSDVTSI

SEQ ID NO: 13173 - protein, 1086 aa, Artificial Sequence
  Description of Artificial Sequence: Synthetic coding sequence
MIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTGNVDFMSLVQGELYFTPCIYTFCY

SEQ ID NO: 13174 - protein, 444 aa, Artificial Sequence
  Description of Artificial Sequence: Synthetic coding sequence
MAPSSRWDAMGPKNSYRSVHGRIVPELLESSVARVRPLQYVQRQPSQASARSGANPTHRPSAEVRPVIRTGEMTHSSVIPPLAPGVRRVSLGYESSPSGSLPPLFNQESPWRRQDSYSPQNPAVSHKASLNSTILQGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 13175 - protein, 1367 aa, Artificial Sequence
  Description of Artificial Sequence: Synthetic coding sequence
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSLPQVCPGPAMAKTPPQMHPVTTPAKNPLQTCLSATMSKTSSQRSPVGVTKPSPQTRLPAMITKTPAQLRSVATILKTLCLASPTVANVKAPPQVAVAAGTPNTSGSIHENPPKAKATVNVKQAAKVVKASSPSYLAEGKIRCLAQPHPGTGVPRAAAELPLEAEKIKTGTQKQAKTDMAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTVGSLLASLCAEVAGVLASQEDLRTLLAKALSQGEVWAALNQALSKEVLGATVTKALPQSMLSMALVKALSWSELRLTLSRALSRGELRAELTKVMQGKLAEVLSKALTEEEWVALSQALCQGELGALLSQSWCRVALRTGTILPKAASKSTGSGVTKTPALVKVACRRSPSAAWGPSLGPVRPQTSKGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 13176 - protein, 1610 aa, Artificial Sequence
  Description of Artificial Sequence: Synthetic coding sequence
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKAATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 13177 - protein, 794 aa, Artificial Sequence
  Description of Artificial Sequence: Synthetic coding sequence
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 13178 - protein, 1423 aa, Artificial Sequence
  Description of Artificial Sequence: Synthetic coding sequence
MYFLSGWPKRLLCPLGSPAEAPFHVQSDPQRAFFAVLAAARLSIWYSRPSVLIVTYKEPAKSSTQFGSYKQAEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEEEPFQDGTYDCSVS

SEQ ID NO: 13179 - protein, 1344 aa, Artificial Sequence
  Description of Artificial Sequence: Synthetic coding sequence
MIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEEEPFQDGTYDCSVS

SEQ ID NO: 13180 - protein, 1026 aa, Artificial Sequence
  Description of Artificial Sequence: Synthetic coding sequence
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLH

SEQ ID NO: 13181 - protein, 1134 aa, Artificial Sequence
  Description of Artificial Sequence: Synthetic coding sequence
MEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSLPQVCPGPAMAKTPPQMHPVTTPAKNPLQTCLSATMSKTSSQRSPVGVTKPSPQTRLPAMITKTPAQLRSVATILKTLCLASPTVANVKAPPQVAVAAGTPNTSGSIHENPPKAKATVNVKQAAKVVKASSPSYLAEGKIRCLAQPHPGTGVPRAAAELPLEAEKIKTGTQKQAKTDMAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 13182 - protein, 685 aa, Artificial Sequence
  Description of Artificial Sequence: Synthetic coding sequence
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIV

SEQ ID NO: 13183 - protein, 1526 aa, Artificial Sequence
  Description of Artificial Sequence: Synthetic coding sequence
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKAATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 13184 - protein, 1307 aa, Artificial Sequence
  Description of Artificial Sequence: Synthetic coding sequence
MIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIREQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEEEPFQDGTYDCSVS

SEQ ID NO: 13185 - protein, 273 aa, Artificial Sequence
  Description of Artificial Sequence: Synthetic coding sequence
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKT

SEQ ID NO: 13186 - protein, 179 aa, Artificial Sequence
  Description of Artificial Sequence: Synthetic coding sequence
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQ

SEQ ID NO: 13187 - protein, 156 aa, Artificial Sequence
  Description of Artificial Sequence: Synthetic coding sequence
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTS

SEQ ID NO: 13188 - protein, 926 aa, Artificial Sequence
  Description of Artificial Sequence: Synthetic coding sequence
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLTQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGLDMDL

SEQ ID NO: 13189 - protein, 205 aa, Artificial Sequence
  Description of Artificial Sequence: Synthetic coding sequence
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFF

SEQ ID NO: 13190 - protein, 91 aa, Artificial Sequence
  Description of Artificial Sequence: Synthetic coding sequence
MAEPGHSHHLSARVRGRTERRIPRLWRLLLWAGTAFQVTQGTGPELHACKESEYHYEYTACDSTGSRWRVAVPHTPGLCTSLPDPIKGTEC

SEQ ID NO: 13191 - protein, 152 aa, Artificial Sequence
  Description of Artificial Sequence: Synthetic coding sequence
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTG

SEQ ID NO: 13192 - protein, 640 aa, Artificial Sequence [sequence omitted]

SEQ ID NO: 13193 - protein, 129 aa, Artificial Sequence
  Description of Artificial Sequence: Synthetic coding sequence
MFYVIGGITVSVVAFFFTIKFLFELAARVVSFLQNEDRERRGDRTIYDYVRGNYLDPRSCKVSWDWKDPYEVGHSMAFRVHLFYKNGQPFPAHRPVGLRVHISHVELAVEIPVTQEVLQEPNSNVVKVA

SEQ ID NO: 13194 - protein, 515 aa, Artificial Sequence
  Description of Artificial Sequence: Synthetic coding sequence
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDRFFSSPLWHPCSSLRQHILPSPDGPAPRHTGLREPRLGQEEASAQPRNFSHNSLRGARPQDPSEEGPGDFGFLHASSSIESEAKPAQPQPTGEKEQDKSKTLSLEEAVTSIQQLFQLSVSIAFNFLGTENMKSGDHTAAFSYFQKAAARGYSKAQYNAGLCHEHGRGTPRDISKAVLYYQLAASQGHSLAQYRYARCLLRDPASSWNPERQRAVSLLKQAADSGLREAQAFLGVLFTKEPYLDEQRAVKYLWLAANNGDSQSRYHLGICYEKGLGVQRNLGEALRCYQQSAALGNEAAQERLRALFSMGAAAPGPSDLTVTGLKSFSSPSLCSLNTLLAGTSRLPHASSTGNLGLLCRSGHLGASLEASSRAIPPHPYPLERSVVRLGFG

SEQ ID NO: 13195 - protein, 515 aa, Artificial Sequence; identical to SEQ ID NO: 13194
  Description of Artificial Sequence: Synthetic coding sequence

SEQ ID NO: 13196 - protein, 217 aa, Artificial Sequence
  Description of Artificial Sequence: Synthetic coding sequence
  MOD_RES (1)..(1): Any amino acid
XAVLYYQLAASQGHSLAQYRYARCLLRDPASSWNPERQRAVSLLKQAADSGLREAQAFLGVLFTKEPYLDEQRAVKYLWLAANNGDSQSRYHLGICYEKGLGVQRNLGEALRCYQQSAALGNEAAQERLRALFSMGAAAPGPSDLTVTGLKSFSSPSLCSLNTLLAGTSRLPHASSTGNLGLLCRSGHLGASLEASSRAIPPHPYPLERSVVRLGFG

SEQ ID NO: 13197 - protein, 519 aa, Artificial Sequence
  Description of Artificial Sequence: Synthetic coding sequence
MARAGPAWLLLAIWVVLPSWLSSAKVSSLIERISDPKDLKKLLRTRNNVLVLYSKSEVAAENHLRLLSTVAQAVKGQGTICWVDCGDAESRKLCKKMKVDLSPKDKKVELFHYQDGAFHTEYNRAVTFKSIVAFLKDPKGPPLWEEDPGAKDVVHLDSEKDFRRLLKKEEKPLLIMFYAPWCSMCKRMMPHFQKAATQLRGHAVLAGMNVYSSEFENIKEEYSVRGFPTICYFEKGRFLFQYDNYGSTAEDIVEWLKNPQPPQPQVPETPWADEGGSVYHLTDEDFDQFVKEHSSVLVMFHAPWCGHCKKMKPEFEKAAEALHGEADSSGVLAAVDATVNKALAERFHISEFPTLKYFKNGEKYAVPVLRTKKKFLEWMQNPEAPPPPEPTWEEQQTSVLHLVGDNFRETLKKKKHTLVMFYAPWCPHCKKVIPHFTATADAFKDDRKIACAAVDCVKDKNQDLCQQEAVKGYPTFHYYHYGKFAEKYDSDRTELGFTNYIRALREGDHERLGKKKEEL

SEQ ID NO: 13198 - protein, 584 aa, Artificial Sequence
  Description of Artificial Sequence: Synthetic coding sequence
MDLLWMPLLLVAACVSAVHSSPEVNAGVSSIHITKPVHILEERSLLVLTPAGLTQMLNQTRFLMVLFHNPSSKQSRNLAEELGKAVEIMGKGKNGIGFGKVDITIEKELQQEFGITKAPELKLFFEGNRSEPISCKGVVESAALVVWLRRQISQKAFLFNSSEQVAEFVISRPLVIVGFFQDLEEEVAELFYDVIKDFPELTFGVITIGNVIGRFHVTLDSVLVFKKGKIVNRQKLINDSTNKQELNRVIKQHLTDFVIEYNTENKDLISELHIMSHMLLFVSKSSESYGIIIQHYKLASKEFQNKILFILVDADEPRNGRVFKYFRVTEVDIPSVQILNLSSDARYKMPSDDITYESLKKFGRSFLSKNATKHQSSEEIPKYWDQGLVKQLVGKNFNVVVFDKEKDVFVMFYAPWSKKCKMLFPLLEELGRKYQNHSTIIIAKIDVTANDIQLMYLDRYPFFRLFPSGSQQAVLYKGEHTLKGFSDFLESHIKTKIEDEDELLSVEQNEVIEEEVLAEEKEVPMMRKGLPEQQSPELENMTKYVSKLEEPAGKKKTSEEVVVVVAKPKGPPVQKKKPKVKEEL

SEQ ID NO: 13199 - protein, 272 aa, Artificial Sequence
  Description of Artificial Sequence: Synthetic coding sequence
MGNTTSDRVSGERHGAKAARSEGAGGHAPGKEHKIMVGSTDDPSVFSLPDSKLPGDKEFVSWQQDLEDSVKPTQQARPTVIRWSEGGKEVFISGSFNNWSTKIPLIKSHNDFVAILDLPEGEHQYKFFVDGQWVHDPSEPVVTSQLGTINNLIHVKKSDFEVFDALKLDSMESSETSCRDLSSSPPGPYGQEMYAFRSEERFKSPPILPPHLLQVILNKDTNISCDPALLPEPNHVMLNHLYALSIKDSVMVLSATHRYKKKYVTTLLYKPI

SEQ ID NO: 13200 - protein, 190 aa, Artificial Sequence
  Description of Artificial Sequence: Synthetic coding sequence
MPRGRSTRSWWGVRTTPACSASLTPSHNDFVAILDLPEGEHQYKFFVDGQWVHDPSEPVVTSQLGTINNLIHVKKSDFEVFDALKLDSMESSETSCRDLSSSPPGPYGQEMYAFRSEERFKSPPILPPHLLQVILNKDTNISCDPALLPEPNHVMLNHLYALSIKDSVMVLSATHRYKKKYVTTLLYKPI

SEQ ID NO: 13201 - protein, 350 aa, Artificial Sequence
  Description of Artificial Sequence: Synthetic coding sequence
MEKQPQNSRRGLAPREVPPAVGLLLIMALMNTLLYLCLDHFFIAPRQSTVDPTHCPYGHFRIGQMKNCSPWLSCEELRTEVRQLKRVGEGAVKRVFLSEWKEHKVALSQLTSLEMKDDFLHGLQMLKSLQGTHVVTLLGYCEDDNTMLTEYHPLGSLSNLEETLNLSKYQNVNTWQHRLELAMDYVSIINYLHHSPVGTRVMCDSNDLPKTLSQYLLTSNFSILANDLDALPLVNHSSGMLVKCGHRELHGDFVAPEQLWPYGEDVPFHDDLMPSYDEKIDIWKIPDISSFLLGHIEGSDMVRFHLFDIHKACKSQTPSERPTAQDVLETYQKVLDTLRDAMMSQAREML

SEQ ID NO: 13202 - protein, 194 aa, Artificial Sequence
  Description of Artificial Sequence: Synthetic coding sequence
MGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRRENHSCVTLLFPR

SEQ ID NO: 13203 - protein, 388 aa, Artificial Sequence
  Description of Artificial Sequence: Synthetic coding sequence
MGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRFSPKEHPVLALPGAPAQFPVLEEHRPLQKYMVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGRPSSFFGMDRPPKLRDEF

SEQ ID NO: 13204 - protein, 177 aa, Artificial Sequence
  Description of Artificial Sequence: Synthetic coding sequence
MVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGRPSSFFGMDRPPKLRDEF

SEQ ID NO: 13205 - protein, 424 aa, Artificial Sequence
  Description of Artificial Sequence: Synthetic coding sequence
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHARCLPTSLSAESGSGGFQRFFCPKYSVSEQMVACVHSGHFHTVCLLV

SEQ ID NO: 13206 - protein, 429 aa, Artificial Sequence
  Description of Artificial Sequence: Synthetic coding sequence
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHARFFIGTSVSTFSFRIHEEREILGLDPKTTYNRFCGDQEKACEQPTHWKITY

SEQ ID NO: 13207 - protein, 392 aa, Artificial Sequence
  Description of Artificial Sequence: Synthetic coding sequence
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 13208 - protein, 1090 aa, Artificial Sequence
  Description of Artificial Sequence: Synthetic coding sequence
MMPMILTVFLSNNEQILTEVPITPETTCRDVVEFCKEPGEGSCHLAEVWRGNERPIPFDHMMYEHLQKWGPRREEVKFFLRHEDSPTENSEQGGRQTQEQRTQRNVINVPGEKRTENGVGNPRVELTLSELQDMAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWTPLHCAASCNSVHLCKQLVESGAAIFASTISDIETAADKCEEMEEGYIQCSQFLYGVQEKLGVMNKGVAYALWDYEAQNSDELSFHEGDALTILRRKDESETEWWWARLGDREGYVPKNLLGLYPRIKPRQRTLA

SEQ ID NO: 13209 - protein, 627 aa, Artificial Sequence
  Description of Artificial Sequence: Synthetic coding sequence
MAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPPFLPAQPLPGLHGHLGRCGQWKHQCQWKPGRAPPCPAHSPTPR

SEQ ID NO: 13210 - protein, 398 aa, Artificial Sequence
  Description of Artificial Sequence: Synthetic coding sequence
MYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWGAGKAGCDEQRCGVCSVGLRGPEQ

SEQ ID NO: 13211 - protein, 635 aa, Artificial Sequence
  Description of Artificial Sequence: Synthetic coding sequence
  MOD_RES (1)..(1): Any amino acid
XVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWGAGKAGCDEQRCGVCSVGLRGPEQ

SEQ ID NO: 13212 - protein, 528 aa, Artificial Sequence
  Description of Artificial Sequence: Synthetic coding sequence
MAEHLELLAEMPMVGRMSTQERLKHAQKRRAQQVKMWAQAEKEAQGKKGPGERPRKEAASQGLLKQVLFPPSVVLLEAAARNDLEEVRQFLGSGVSPDLANEDGLTALHQCCIDDFREMVQQLLEAGANINACDSECWTPLHAAATCGHLHLVELLIASGANLLAVNTDGNMPYDLCDDEQTLDCLETAMADRGITQDSIEAARAVPELRMLDDIRSRLQAGADLHAPLDHGATLLHVAAANGFSEAAALLLEHRASLSAKDQDGWEPLHAAAYWGQVPLVELLVAHGADLNAKSLMDETPLDVCGDEEVRAKLLELKHKHDALLRAQSRQRSLLRRRTSSAGSRGKVVRRVSLTQRTDLYRKQHAQEAIVWQQPPPTSPEPPEDNDDRQTGAELRPPPPEEDNPEVVRPHNGRVGGSPVRHLYSKRLDRSVSYQLSPLDSTTPHTLVHDKAHHTLADLKRQRAAAKLQRPPPEGPESPETAEPGLPGDTVTPQPDCGFRAGGDPPLLKLTAPAVEAPVERRPCCLLM

SEQ ID NO: 13213 - protein, 528 aa, Artificial Sequence; identical to SEQ ID NO: 13212
  Description of Artificial Sequence: Synthetic coding sequence

SEQ ID NO: 13214 - protein, 279 aa, Artificial Sequence
  Description of Artificial Sequence: Synthetic coding sequence
MSRERPPGTDIPRNLSFIAALTERAYYRSQRPSLEEEPEEEPGEGGTRFGARSRAHAPSRGRRARSAPAGGGGARAPRSRSPDTRKRVRFADALGLELAVVRRFRPGELPRVPRHVQIQLQRDALRHFAPCQPRARGLQEARAALEPASEPGFAARLLTQRICLERAEAGPLGVAGSARVVDLAYEKRVSVRWSADGWRSQREAPAAYAGPAPPPPRADRFAFRLPAPPIGGALLFALRYRVTGHEFWDNNGGRDYALRGPEHPGSGGAPEPQGWIHFI

SEQ ID NO: 13215 - protein, 49 aa, Artificial Sequence
  Description of Artificial Sequence: Synthetic coding sequence
  MOD_RES (1)..(1): Any amino acid
XGALLFALRYRVTGHEFWDNNGGRDYALRGPEHPGSGGAPEPQGWIHFI

SEQ ID NO: 13216 - protein, 34 aa, Artificial Sequence
  Description of Artificial Sequence: Synthetic coding sequence
  MOD_RES (1)..(1): Any amino acid
XFWDNNGGRDYALRGPEHPGSGGAPEPQGWIHFI

SEQ ID NO: 13217 - protein, 18 aa, Artificial Sequence
  Description of Artificial Sequence: Synthetic coding sequence
EHPGSGGAPEPQGWIHFI

SEQ ID NO: 13218 - protein, 29 aa, Artificial Sequence
  Description of Artificial Sequence: Synthetic coding sequence
NGGRDYALRGPEHPGSGGAPEPQGWIHFI

SEQ ID NO: 13219 - protein, 13 aa, Artificial Sequence
  Description of Artificial Sequence: Synthetic coding sequence
  MOD_RES (1)..(1): Any amino acid
XGAPEPQGWIHFI

SEQ ID NO: 13220 - protein, 799 aa, Artificial Sequence
  Description of Artificial Sequence: Synthetic coding sequence
MARTAPVEPPLRHSAPPSPAAGEPRTSVEAAVAPRRVLFADEALGLPLAQLRRYRPWGGPGAGKMAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVSDVPMTGNPAEEGDVPRSSPPVAFTEVLQAPAIRIPPSSPLCGLGGSPRDQASGPDASEGATGPFLEPSQQQAEATWGVSSENGGGLEAVSGSEELLGEDTIDQELEQLYLSHLSRLRAAVAAGGAGGGGEGSTDGGMSPSHPLGILTDRDLILKWPGPERALNSALAEEITLHYARLGRGVELIKDTEDPDDEGEGEEGLSVTPSSPEGDSPKESPPEILSGARSVVATMGDVWLPWAEGSGCDGPVVLGTEGQFIGDPEKGMGKDTSSLHMNRVIAGVTESLGEAGTEAQIEVTSEWAGSLDPISGKEPASPVLLQGQNPTLLSPLGAEVCLSSVARPHVSSQDEKDAGPSLEPPKKSPTLAVPAECVCALPPQLRGPLTQTLGVLAGLVVVPVALNSGVSLLVLALCLSLAWFS

SEQ ID NO: 13221 - protein, 470 aa, Artificial Sequence
  Description of Artificial Sequence: Synthetic coding sequence
MKPVRRRPAEEELKTKNMDDNTFAMEHPDVQESVGPLVAPTPLRPWPQMTLQVSDVPMTGNPAEEGDVPRSSPPVAFTEVLQAPAIRIPPSSPLCGLGGSPRDQASGPDASEGATGPFLEPSQQQAEATWGVSSENGGGLEAVSGSEELLGEDTIDQELEQLYLSHLSRLRAAVAAGGAGGGGEGSTDGGMSPSHPLGILTDRDLILKWPGPERALNSALAEEITLHYARLGRGVELIKDTEDPDDEGEGEEGLSVTPSSPEGDSPKESPPEILSGARSVVATMGDVWLPWAEGSGCDGPVVLGTEGQFIGDPEKGMGKDTSSLHMNRVIAGVTESLGEAGTEAQIEVTSEWAGSLDPISGKEPASPVLLQGQNPTLLSPLGAEVCLSSVARPHVSSQDEKDAGPSLEPPKKSPTLAVPAECVCALPPQLRGPLTQTLGVLAGLVVVPVALNSGVSLLVLALCLSLAWFS

SEQ ID NO: 13222 - protein, 455 aa, Artificial Sequence
  Description of Artificial Sequence: Synthetic coding sequence
MFCSGRKWVAEATICTKLMKREKRRMGKRRAKKAKREEKKKGGERRRNEKRGNQMKRMCERKKYETDLEDQDIMGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASKRNVIEAVYNRLNPYKNDDTDSTSTDDMW

SEQ ID NO: 13223 - protein, 324 aa, Artificial Sequence
  Description of Artificial Sequence: Synthetic coding sequence
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEGGSFNKK

SEQ ID NO: 13224 - protein, 382 aa, Artificial Sequence
  Description of Artificial Sequence: Synthetic coding sequence
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASKRNVIEAVYNRLNPYKNDDTDSTSTDDMW

SEQ ID NO: 13225 - protein, 187 aa, Artificial Sequence
  Description of Artificial Sequence: Synthetic coding sequence
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRV

SEQ ID NO: 13226 - protein, 129 aa, Artificial Sequence
  Description of Artificial Sequence: Synthetic coding sequence
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTA

SEQ ID NO: 13227 - protein, 382 aa, Artificial Sequence; identical to SEQ ID NO: 13224
  Description of Artificial Sequence: Synthetic coding sequence

SEQ ID NO: 13228 - protein, 148 aa, Artificial Sequence
  Description of Artificial Sequence: Synthetic coding sequence
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSR

SEQ ID NO: 13229 - protein, 788 aa, Artificial Sequence
  Description of Artificial Sequence: Synthetic coding sequence
THYLSPGLSDFYLNHSPASTCTLRRSLGSETGKCLPAHSLLPKFFPCREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHSQEFLKFATTEAIQRTEIFEYCQMLGRPKSFIPSFQVYKLLYASRLADYGLVSQALHYCEAIGAAVLSQGESSHPVLLVELIKLAEKLKLSDPLVLERRSGDRDLEPDWLAQLRRQLEQKVAGDIGDPHPTRSDISGAGGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEQETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLSASLSHPAMLRINTRPRLISQD

SEQ ID NO: 13230 - protein, 1060 aa, Artificial Sequence
  Description of Artificial Sequence: Synthetic coding sequence
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPGYENSYQSYQSPTMREEYAYGSYYYHGHPQWLQEERVPRQRSPYIWHEDYREQKYLDEHHYENQHSPFGTNSETHFQSNSRNPCKDSPASNSGQEWPGELFPGSLLAEAQKNKPSLASESNLLQQRESGLSSSSYELSQYIRDAPERDDPPASAAWSPVQADVSSAGPKAPMKFYIPHVPVSFGPGGQLVHVGPSSPTDGQAALVELHSMEVILNDSEEQEEMRSFSGPLIREDVHKVDIMTFCQQKAAQSCKSETLGSRDSALLWQLLVLLCRQNGSMVGSDIAELLMQDCKKLEKYKRQPPVANLINLTDEDWPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHSQEFLKFATTEAIQRTEIFEYCQMLGRPKSFIPSFQVYKLLYASRLADYGLVSQALHYCEAIGAAVLSQGESSHPVLLVELIKLAEKLKLSDPLVLERRSGDRDLEPDWLAQLRRQLEQKVAGDIGDPHPTRSDISGAGGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 13231 - protein, 745 aa, Artificial Sequence
  Description of Artificial Sequence: Synthetic coding sequence
MELWAPQRLPQTRGKATAPSKDPDRGFRRDGHHRPVPHSWHNGERFHQWQDNRGSPQPQQEPRADHQQQPHYASRPGDWHQPVSGVDYYEGGYRNQLYSRPVLSSGTPNLLTGEIPPSVETPAQIVEKFTRLLYYGRKKEALEWAMKNHLWGHALFLSSKMDPQTYSWVMSGFTSTLALNDPLQTLFQLMSGRIPQAATCCGEKQWGDWRPHLAVILSNQAGDPELYQRAIVAIGDTLAGKGLVEAAHFCYLMAHVPFGHYTVKTDHLVLLGSSHSQEFLKFATTEAIQRTEIFEYCQMLGRPKSFIPSFQVYKLLYASRLADYGLVSQALHYCEAIGAAVLSQGESSHPVLLVELIKLAEKLKLSDPLVLERRSGDRDLEPDWLAQLRRQLEQKVAGDIGDPHPTRSDISGAGGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEQETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 13232 - protein, 151 aa, Artificial Sequence
  Description of Artificial Sequence: Synthetic coding sequence
MAATALLEAGLARVLFYPTLLYTLFRGKVPGRAHRDWYHRIDPTVLLGALPLRSLTRQVSRAGEPGPLPRPRRSVPVGPLGSPPSLLSHLFASAAGTGRERARGDHHERGVRDEVPVQLFTGAQMESRGGCKSHRQDPVIHPHQAWPAGCS

SEQ ID NO: 13233 - protein, 1152 aa, Artificial Sequence
  Description of Artificial Sequence: Synthetic coding sequence
MIFSDMNTVSGSPKVHPPNGTRFYTFQEFAALTKELNACREQLLEKEEEISELKAERNNTRLLLEHLECLVSRHERSLRMTVVKRQAQSPSGVSSEVEVLKALKSLFEHHKALDEKIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 13234 - protein, 783 aa, Artificial Sequence
  Description of Artificial Sequence: Synthetic coding sequence
MRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDDGVFSVYST

SEQ ID NO: 13235 - protein, 1251 aa, Artificial Sequence
  Description of Artificial Sequence: Synthetic coding sequence
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 13236 - protein, 1232 aa, Artificial Sequence
  Description of Artificial Sequence: Synthetic coding sequence
MMCEVMPTINEDTPMSQRGSQSSGSDSDSHFEQLMVNMLDERDRLLDTLRETQESLSLAQQRLQDVIYDRDSLQRQLNSALPQEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKNTSGHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDDGVFSVYST

SEQ ID NO: 13237 - protein, 1210 aa, Artificial Sequence [sequence omitted]

SEQ ID NO: 13238 - protein, 1236 aa, Artificial Sequence
  Description of Artificial Sequence: Synthetic coding sequence
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 13239 - protein, 545 aa, Artificial Sequence
  Description of Artificial Sequence: Synthetic coding sequence
MQSISKQTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 13240 - protein, 201 aa, Artificial Sequence
  Description of Artificial Sequence: Synthetic coding sequence
MAATALLEAGLARVLFYPTLLYTLFRGKVPGRAHRDWYHRIDPTVLLGALPLRSLTRQLVQDENVRGVITMNEEYETRFLCNSSQEWKRLGVEQLRLSTVDMTGIPTLDNLQKGVQFALKYQSLGQCVYVHCKAGRSRSATMVAAYLIQVHKWSPEEAVRAIAKIRSYIHIRPGQLDVLKEFHKQITARATKDGTFVISKT

SEQ ID NO: 13241 - protein, 759 aa, Artificial Sequence
  Description of Artificial Sequence: Synthetic coding sequence
MAGSKQSHQEAVKRHLYFLQLKMDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 13242 - protein, 913 aa, Artificial Sequence
  Description of Artificial Sequence: Synthetic coding sequence
MTSRLRALGGRINNIRTSELPKEKTRSEVICSIHFLDGVVQTFKVTKQDTGQVLLDMVHNHLGVTEKEYFGLQHDDDSVDSPRWLEASKAIRKQLKGGFPCTLHFRVRFFIPDPNTLQQEQTRHLYFLQLKMDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 13243 - protein, 381 aa, Artificial Sequence
  Description of Artificial Sequence: Synthetic coding sequence
MPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 13244 - protein, 913 aa, Artificial Sequence; identical to SEQ ID NO: 13242
  Description of Artificial Sequence: Synthetic coding sequence

SEQ ID NO: 13245 - protein, 782 aa, Artificial Sequence
  Description of Artificial Sequence: Synthetic coding sequence
MDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKSVNNQYCKKVIGGMVWNPAMRRSLSVEHLETKSLPSRSPPITPNWRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 13246 - protein, 737 aa, Artificial Sequence
  Description of Artificial Sequence: Synthetic coding sequence
MDICEGRLTCPLNSAVVLASYAVQSHFGDYNSSIHHPGYLSDSHFIPDQNEDFLTKVESLHEQHSGLKQSEAESCYINIARTLDFYGVELHSGRDLHNLDLMIGIASAGVAVYRKYICTSFYPWVNILKISFKRKKFFIHQRQKQAESREHIVAFNMLNYRSCKNLWKSCVEHHTFFQAKKLLPQEKNVLSQYWTMGSRNTKKRSPRLRHEIRKPRHSSADNLANEMTYITETEDVFYTYKGSLAPQDSDSEVSQNRSPHQESLSENNPAQSYLTQKSSSSVSPSSNAPGSCSPDGVDQQLLDDFHRVTKGGSTEDASQYYCDKNDNGDSYLVLIRITPDEDGKFGFNLKGGVDQKMPLVVSRINPESPADTCIPKLNEGDQIVLINGRDISEHTHDQVVMFIKASRESHSRELALVIRRRAVRSFADFKSEDELNQLFPEAIFPMCPEGGDTLEGSMAQLKKGLESGTVLIQFEQLYRKKPGLAITFAKLPQNLDKNRYKDVLPYDTTRVLLQGNEDYINASYVNMEIPAANLVNKYIATQGPLPHTCAQFWQVVWDQKLSLIVMLTTLTERGRTKCHQYWPDPPDVMNHGGFHIQCQSEDCTIAYVSREMLVTNTQTGEEHTVTHLQYVAWPDHGVPDDSSDFLEFVNYVRSLRVDSEPVLVHCSAGIGRTGVLVTMETAMCLTERNLPIYPLDIVRKMRDQRAMMVQTSSQYKFVCEAILRVYEEGLVQMLDPS

SEQ ID NO: 13247 - protein, 926 aa, Artificial Sequence
  Description of Artificial Sequence: Synthetic coding sequence
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKRGSPYSLNFRVKFFVSDPNKLQEEYTRYQYFLQIKQDILTGRLPCPSNTAALLASFAVQSELGDYDQSENLSGYLSDYSFIPNQPQDFEKEIAKLHQQHIGLSPAEAEFNYLNTARTLELYGVEFHYARDQSNNEIMIGVMSGGILIYKNRVRMNTFPWLKIVKISFKCKQFFIQLRKELHESRETLLGFNMVNYRACKNLWKACVEHHTFFRLDRPLPPQKNFFAHYFTLGSKFRYCGRTEVQSVQYGKEKANKDRVFARSPSKPLARKLMDWEVVSRNSISDDRLETQSLPSRSPPGTPNHRNSTFTQEGTRLRPSSVGHLVDHMVHTSPSEVFVNQRSPSSTQANSIVLESSPSQETPGDGKPPALPPKQSKKNSWNQIHYSHSQQDLESHINETFDIPSSPEKPTPNGGIPHDNLVLIRMKPDENGRFGFNVKGGYDQKMPVIVSRVAPGTPADLCVPRLNEGDQVVLINGRDIAEHTHDQVVLFIKASCERHSGELMLLVRPNAVYDVVEEKLENEPDFQYIPEKAPLDSVHQDDHSLRESMIQLAEGLITGTVLTQFDQLYRKKPGMTMSCAKLPQNISKNRYRDISPYDATRVILKGNEDYINANYINMEIPSSSIINQYIACQGPLPHTCTDFWQMTWEQGSSMVVMLTTQVERGRVKCHQYWPEPTGSSSYGCYQVTCHSEEGNTAYIFRKMTLFNQEKNESRPLTQIQYIAWPDHGVPDDSSDFLDFVCHVRNKRAGKEEPVVVHCSAGIGRTGVLITMETAMCLIECNQPVYPLDIVRTMRDQRAMMIQTPSQYRFVCEAILKVYEEGFVKPLTTSTNK

SEQ ID NO: 13248 - protein, 75 aa, Artificial Sequence
  Description of Artificial Sequence: Synthetic coding sequence
MTSRFRLPAGRTYNVRASELARDRQHTEVVCNILLLDNTVQAFKVNKHDQGQVLLDVVFKHLDLTEQDYFGLQLA

SEQ ID NO: 13249 - protein, 161 aa, Artificial Sequence
  Description of Artificial Sequence: Synthetic coding sequence
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKKLLLLILGGSPYSLNFRVKFFVSDPNKLQEEYTRYQYFLQIKQDILTGRLPCPSNTAALLASFAV

SEQ ID NO: 13250 - protein, 559 aa, Artificial Sequence
  Description of Artificial Sequence: Synthetic coding sequence
MDWEVVSRNSISDDRLETQSLPSRSPPGTPNHRNSTFTQEGTRLRPSSVGHLVDHMVHTSPSEVFVNQRSPSSTQANSIVLESSPSQETPGDGKPPALPPKQSKKNSWNQIHYSHSQQDLESHINETFDIPSSPEKPTPNGGIPHDNLVLIRMKPDENGRFGFNVKGGYDQKMPVIVSRVAPGTPADLCVPRLNEGDQVVLINGRDIAEHTHDQVVLFIKASCERHSGELMLLVRPNAVYDVVEEKLENEPDFQYIPEKAPLDSVHQDDHSLRESMIQLAEGLITGTVLTQFDQLYRKKPGMTMSCAKLPQNISKNRYRDISPYDATRVILKGNEDYINANYINMEIPSSSIINQYIACQGPLPHTCTDFWQMTWEQGSSMVVMLTTQVERGRVKCHQYWPEPTGSSSYGCYQVTCHSEEGNTAYIFRKMTLFNQEKNESRPLTQIQYIAWPDHGVPDDSSDFLDFVCHVRNKRAGKEEPVVVHCSAGIGRTGVLITMETAMCLIECNQPVYPLDIVRTMRDQRAMMIQTPSQYRFVCEAILKVYEEGFVKPLTTSTNK

SEQ ID NO: 13251 - protein, 1235 aa, Artificial Sequence
  Description of Artificial Sequence: Synthetic coding sequence
MMCEVMPTINEDTPMSQRGSQSSGSDSDSHFEQLMVNMLDERDRLLDTLRETQESLSLAQQRLQDVIYDRDSLQRQLNSALPQEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKVIRHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQCPVFLQTLAYGDMNHEWIGNEWLPSLGLPQYRSYFMECLVDARMLDHLTKKDLRVHLKMVDSFHRKKRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDDGVFSVYST

SEQ ID NO: 13252 - protein, 1156 aa, Artificial Sequence
  Description of Artificial Sequence: Synthetic coding sequence
MIFSDMNTVSGSPKVHPPNGTRFYTFQEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTKESEEGSWAQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 13253 - protein, 443 aa, Artificial Sequence
  Description of Artificial Sequence: Synthetic coding sequence
MTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 13254 - protein, 1260 aa, Artificial Sequence
  Description of Artificial Sequence: Synthetic coding sequence
RSKDPKSQTLAMMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQANARQILEREYNNLLALGTERRLDESDDKNFRRGSTWRRQFPPREVHGISMMPGSSETLPAGFRLTTTSGQSRKMTTDDGVFSVYST

SEQ ID NO: 13255 - protein, 121 aa, Artificial Sequence
  Description of Artificial Sequence: Synthetic coding sequence
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKE

SEQ ID NO: 13256 - protein, 1257 aa, Artificial Sequence
  Description of Artificial Sequence: Synthetic coding sequence
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 13257 - protein, 657 aa, Artificial Sequence
  Description of Artificial Sequence: Synthetic coding sequence
MRRAVCFPALCLLLNLHAAGCFSGNNDHFLAINQKKSGKPVFIYKHSQDIEKSLDIAPQKIYRHSYHSSSEAQVSKRHQIVNSAFPRPAYDPSLNLLAMDGQDLEVENLPIPAANVIVVTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 13258 - protein, 451 aa, Artificial Sequence
  Description of Artificial Sequence: Synthetic coding sequence
MNQKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 13259 - protein, 412 aa, Artificial Sequence
  Description of Artificial Sequence: Synthetic coding sequence
MILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 13260 - protein, 412 aa, Artificial Sequence; identical to SEQ ID NO: 13259
  Description of Artificial Sequence: Synthetic coding sequence

SEQ ID NO: 13261 - protein, 198 aa, Artificial Sequence
  Description of Artificial Sequence: Synthetic coding sequence
MILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSL

SEQ ID NO: 13262 - protein, 1450 aa, Artificial Sequence
  Description of Artificial Sequence: Synthetic coding sequence
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 13263 - protein, 1451 aa, Artificial Sequence
  Description of Artificial Sequence: Synthetic coding sequence
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRHPAEHTVGNATLGRAASPGMVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 13264 - protein, 1441 aa, Artificial Sequence
  Description of Artificial Sequence: Synthetic coding sequence
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 13265 - protein, 1440 aa, Artificial Sequence
  Description of Artificial Sequence: Synthetic coding sequence
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFNGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 13266 - protein, 1444 aa, Artificial Sequence
  Description of Artificial Sequence: Synthetic coding sequence
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRRNAYSYSYYLSQRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 13267 - protein, 1463 aa, Artificial Sequence
  Description of Artificial Sequence: Synthetic coding sequence
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLSQRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 13268 - protein, 1431 aa, Artificial Sequence
  Description of Artificial Sequence: Synthetic coding sequence
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 13269 - protein, 254 aa, Artificial Sequence
  Description of Artificial Sequence: Synthetic coding sequence
MAAVAATAAAKGNGGGGGRAGAGDASGTRKKKGPGPLATAYLVIYNVVMTAGWLVIAVGLVRAYLAKGSYHSLYYSIEKPLKFFQTGALLEILHCAIGIVPSSVVLTSFQVMSRVFLIWAVTHSVKEVQSEDSVLLFVIAWTITEIIRYSFYTFSLLNHLPYLIKWARYTLFIVLYPMGVSGELLTIYAALPFVRQAGLYSISLPNKYNFSFDYYAFLILIMISYIPIFPQLYFHMIHQRRKILSHTEEHKKFE

SEQ ID NO: 13270 - protein, 362 aa, Artificial Sequence
  Description of Artificial Sequence: Synthetic coding sequence
MENQVLTPHVYWAQRHRELYLRVELSDVQNPAISITENVLHFKAQGHGAKGDNVYEFHLEFLDLVKPEPVYKLTQRQVNITVQKKVSQWWERLTKQEKRPLFLAPDFDRWLDESDAEMELRAKEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 13271 - protein, 232 aa, Artificial Sequence
  Description of Artificial Sequence: Synthetic coding sequence
MGPLALPAWLQPRYRKNAYLFIYYLIQFCGHSWIFTNMTVRFFSFGKDSMVDTFYAIGLVMRLCQSVSLLELLHIYVGIESNHLLPRFLQLTERIIILFVVITSQEEVQEKYVVCVLFVFWNLLDMVRYTYSMLSVIGISYAVLTWLSQTLWMPIYPLCVLAEAFAIYQSLPYFESFGTYSTKLPFDLSIYFPYVLKIYLMMLFIGMYFTYSHLYSERRDILGIFPIKKKKM

SEQ ID NO: 13272 - protein, 232 aa, Artificial Sequence; identical to SEQ ID NO: 13271
  Description of Artificial Sequence: Synthetic coding sequence

SEQ ID NO: 13273 - protein, 798 aa, Artificial Sequence
  Description of Artificial Sequence: Synthetic coding sequence
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKVSV

SEQ ID NO: 13274 - protein, 901 aa, Artificial Sequence
  Description of Artificial Sequence: Synthetic coding sequence
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKPRQPNPDWRYSASLRAGMHSSVHLEEAGILRAGPGGPDQQWPTVSSATPEPEAGEVSPPVGAGVNSNSWTFKYGPGNPKQSGPEPKKQTQVSFLLRRKGEASQPRQ

SEQ ID NO: 13275 - protein, 947 aa, Artificial Sequence
  Description of Artificial Sequence: Synthetic coding sequence
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 13276 - protein, 800 aa, Artificial Sequence
  Description of Artificial Sequence: Synthetic coding sequence
MAVRELCFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYLVVALASVSSLFLLSVLLFVAVRLCRRSRAASVGRCSVPEGPFPGHLVDVRGAETLSQSYQYEVCLTGGPGTSEFKFLKPVISDIQAQGPGRKGEENSTFRNSFGFNIQ

SEQ ID NO: 13277 - protein, 587 aa, Artificial Sequence
  Description of Artificial Sequence: Synthetic coding sequence
MMETPLPKAPEKRQVTAIIFLLLLWEAGSATIKYSVLEERDSGSFVANLAKDLGLGVGELAARGARILSKGNKQYLQLERKSGNLLLKEKLDREELCGDIDPCILHFQMLLKNPVQFIQGELQLQDVNDHAPEFLENEILLKISEGSHPGTSFPLKIAQDLDVGSNTVQNYSISTNSYFHLFTRNHSDGKKYPELVLDQALDREEQPQLRLTLTALDGGSPPRTGTSQVLIVIVDINDNVPEFAQRRYEVQVPENTPIGSLVITVSARDLDAGTHGELSYSFFQYSNQIIQAFEINSITGEIRFKKALDFEEIQSYHMEVEASDGGGLSGKCTVAIEVMDINDNAPELTMSLLISDILENSPETVVAVFGISDPDSGNNGKMMCSIQDHLPFLLKPTLENFYTLLTEGALDRESRAEYNITITVTDLGTPRLKTEYNITLRVSDVNDNAPAFTQTSYTLFVRENNSPALHIGSVSATDRDSGTNAQVTYSLLPPQNPHLPLASLVSINTDNGHLFALRSLDYEALQEFEFRVGASDRGSPALSSEALVRVLVCWTPTTTRPSCCTRCRTAPRPAPSWCPGRPSRATW

SEQ ID NO: 13278 - protein, 241 aa, Artificial Sequence
  Description of Artificial Sequence: Synthetic coding sequence
MEDYLQGCRAALQERTIILDCVNMDLKIGKATPKDSKYVEKLEALFPDLPKRNDIFDSLQKAKFDVSGLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 13279 - protein, 453 aa, Artificial Sequence
  Description of Artificial Sequence: Synthetic coding sequence
MEDYLQGCRAALQESRPLHVVLGNEACDLDSTVSALALAFYLAKTTEAEEVFVPVLNIKRSELPLRGDIVFFLQKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 13280 - protein, 386 aa, Artificial Sequence
  Description of Artificial Sequence: Synthetic coding sequence
MEDYLQGCRAALQESRPLHVVLGNEACDLDSTVSALALAFYLAKRSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 13281 - protein, 218 aa, Artificial Sequence
  Description of Artificial Sequence: Synthetic coding sequence
MDLKIGKATPKDSKYVEKLEALFPDLPKRNDIFDSLQKAKFDVSGLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 13282 - protein, 168 aa, Artificial Sequence
  Description of Artificial Sequence: Synthetic coding sequence
MLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 13283 - protein, 271 aa, Artificial Sequence
  Description of Artificial Sequence: Synthetic coding sequence
MDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 13284 - protein, 218 aa, Artificial Sequence; identical to SEQ ID NO: 13281
  Description of Artificial Sequence: Synthetic coding sequence

SEQ ID NO: 13285 - protein, 178 aa, Artificial Sequence
  Description of Artificial Sequence: Synthetic coding sequence
MDLKIGKATPKDSKYVEKLEALFPDLPKRNDIFDSLQKAKFDVSGLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMN

SEQ ID NO: 13286 - protein, 140 aa, Artificial Sequence
  Description of Artificial Sequence: Synthetic coding sequence
MDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSP

SEQ ID NO: 13287 - protein, 1746 aa, Artificial Sequence
  Description of Artificial Sequence: Synthetic coding sequence
MSACNTFTEHVWKPGECKNCFKPKSLHQLPPDPEKAPITHGNVKTNANHSNNHRIRNTGNFRPPVAKKPTIAVKPTMIVADGQSICGELSIQEHCENKPVIIGWNRNRAALSQKPLNNNNEDDEGISHVPKPYGNNDSAKKMSDNNNGLTEVLKEIAGLDTAPQIRGNETNSRETFLGRINDCYKRSLERKLPPSCMIGGIKETQGKHVILSGSTEVISNEGGRFCYPEFSSGEESEEDVLFSNMEEEHESWDESDEELLAMEIRMRGQPRFANFRANTLSPVRFFVDKKWNTIPLRNKSLQRICAVDYDDSYDEILNGYEENSVVSYGQGSIQSMVSSDSTSPDSSLTEESRSETASSLSQKICNGGLSPGNPGDSKDMKEIEPNYESPSSNNQDKDSSQASKSSIKVPETHKAVLALRLEEKDGKIAVQTEKEESKASTDVAGQAVTINLVPTEEQAKPYRVVNLEQPLCKPYTVVDVSAAMASEHLEGPVNSPKTKSSSSTPNSPVTSSSLTPGQISAHFQKSSAIRYQEVWTSSTSPRQKIPKVELITSGTGPNVPPRKNCHKSAPTSPTATNISSKTIPVKSPNLSEIKFNSYNNAGMPPFPIIIHDEPTYARSSKNAIKVPIVINPNAYDNLAIYKSFLGTSGELSVKEKTTSVISHTYEEIETESKVPDNTTSKTTDCLQTKGFSNSTEHKRGSVAQKVQEFNNCLNRGQSSPQRSYSSSHSSPAKIQRATQEPVAKIEGTQESQMVGSSSTREKASTVLSQIVASIQPPQSPPETPQSGPKACSVEELYAIPPDADVAKSTPKSTPVRPKSLFTSQPSGEAEAPQTTDSPTTKVQKDPSIKPVTPSPSKLVTSPQSEPPAPFPPPRSTSSPYHAGNLLQRHFTNWTKPTSPTRSTEAESVLHSEGSRRAADAKPKRWISFKSFFRRRKTDEEDDKEKEREKGKLVGLDGTVIHMLPPPPVQRHHWFTEAKGESSEKPAIVFMYRCDPAQGQLSVDQSKARTDQAAVMEKGRAENALLQDSEKKRSHSSPSQIPKKILSHMTHEVTEDFSPRDPRTVVGKQDGRGCTSVTTALSLPELEREDGKEDISDPMDPNPCSATYSNLGQSRAAMIPPKQPRQPKGAVDDAIAFGGKTDQEAPNASQPTPPPLPKKMIIRANTEPISKDLQKSMESSLCVMANPTYDIDPNWDASSAGSSISYELKGLDIESYDSLERPLRKERPVPSAANSISSLTTLSIKDRFSNSMESLSSRRGPSCRQGRGIQKPQRQALYRGLENREEVVGKIRSLHTDALKKLAVKCEDLFMAGQKDQLRFGVDSWSDFRLTSDKPCCEAGDAVYYTASYAKDPLNNYAVKICKSKAKESQQYYHSLAVRQSLAVHFNIQQDCGHFLAEVPNRLLPWEDPDDPEKDEDDMEETEEDAKGETDGKNPKPCSEAASSQKENQGVMSKKQRSHVVVITREVPCLTVADFVRDSLAQHGKSPDLYERQVCLLLLQLCSGLEHLKPYHVTHCDLRLENLLLVHYQPGGTAQGFGPAEPSPTSSYPTRLIVSNFSQAKQKSHLVDPEILRDQSRLAPEIITATQYKKCDEFQTGILIYEMLHLPNPFDENPELKEREYTRADLPRIPFRSPYSRGLQQLASCLLNPNPSERILISDAKGILQCLLWGPREDLFQTFTACPSLVQRNTLLQNWLDIKRTLLMIKFAEKSLDREGGISLEDWLCAQYLAFATTDSLSCIVKILQHR

SEQ ID NO: 13288 - protein, 1746 aa, Artificial Sequence; identical to SEQ ID NO: 13287
  Description of Artificial Sequence: Synthetic coding sequence

SEQ ID NO: 13289 - protein, 1005 aa, Artificial Sequence
  Description of Artificial Sequence: Synthetic coding sequence
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDENFKKKLKEKNIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLDRKRSASAPTLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 13290 - protein, 1011 aa, Artificial Sequence
  Description of Artificial Sequence: Synthetic coding sequence
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 13291 - protein, 170 aa, Artificial Sequence
  Description of Artificial Sequence: Synthetic coding sequence
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQVCAEARTKMGFPC

SEQ ID NO: 13292 - protein, 86 aa, Artificial Sequence
  Description of Artificial Sequence: Synthetic coding sequence
MMSDASDMLAAALEQMDGIIAGSKALEYSNGIFDCQSPTSPFMGSLRALHLVEDLRGLLEMMETDEKEGLRCQIPDSTAETLVEWL

SEQ ID NO: 13293 - protein, 858 aa, Artificial Sequence
  Description of Artificial Sequence: Synthetic coding sequence
MLQQELLSRTSLETQKLDLMAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 13294 - protein, 18 aa, Artificial Sequence
  Description of Artificial Sequence: Synthetic coding sequence
MLQQELLSRTSLETQKLD

SEQ ID NO: 13295 - protein, 980 aa, Artificial Sequence
  Description of Artificial Sequence: Synthetic coding sequence
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDIEVQKMKKAVESLMAANEEKDRKIEDLRQCLNRYKKMQDTVVLAQGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 13296 - protein, 283 aa, Artificial Sequence
  Description of Artificial Sequence: Synthetic coding sequence
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQAMVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDENFKKKLKEK

SEQ ID NO: 13297 - protein, 281 aa, Artificial Sequence
  Description of Artificial Sequence: Synthetic coding sequence
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDENFKKKLKEK

SEQ ID NO: 13298 - protein, 398 aa, Artificial Sequence
  Description of Artificial Sequence: Synthetic coding sequence
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQNEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 13299 - protein, 415 aa, Artificial Sequence
  Description of Artificial Sequence: Synthetic coding sequence
MCPQLAGAGSMGSPGATTGWGLLDYKTEKWALLAKKGYQERDLEPQFSIITKLKGVSVTQIKELGNRLWDVADFVKPPQGENVFFLVTNFLVTPAQVQGRCPEHPSVPLANCWVDEDCPEGEGGTHSHGVKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 13300 - protein, 497 aa, Artificial Sequence
  Description of Artificial Sequence: Synthetic coding sequence
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVVRNPLWGPSGCGGSTRPLHTGLCWPQGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 13301 - protein, 404 aa, Artificial Sequence
  Description of Artificial Sequence: Synthetic coding sequence
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKMVDTPASEPAQASTPTDPKGLAQL

SEQ ID NO: 13302 - protein, 447 aa, Artificial Sequence
  Description of Artificial Sequence: Synthetic coding sequence
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 13303 - protein, 379 aa, Artificial Sequence
  Description of Artificial Sequence: Synthetic coding sequence
MAAAQPKYPAGATARRLARGCWSALWDYETPKVIVSIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 13304 - protein, 399 aa, Artificial Sequence
  Description of Artificial Sequence: Synthetic coding sequence
MAAAQPKYPAGATARRLARGCWSALWDYETPKVIVVRIHRAEKLPGERDGPRELHHHQGQGDHHVRAQSVGRGGVREAPRGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 13305 - protein, 471 aa, Artificial Sequence
  Description of Artificial Sequence: Synthetic coding sequence
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 13306 - protein, 370 aa, Artificial Sequence
  Description of Artificial Sequence: Synthetic coding sequence
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPESIRVHNATCLSDADCVAGELDMLGNGALQDLRGVRLVPGGRWGLCQPISGYDGPKFHHPHQEQHPLPQIPLLQGQHRRPHRRVPEALHVPRGLRPLLPHLQAGLYRGEGWGELHRARTQGRGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKMVDTPASEPAQASTPTDPKGLAQL

SEQ ID NO: 13307 - protein, 422 aa, Artificial Sequence
  Description of Artificial Sequence: Synthetic coding sequence
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 13308 - protein, 432 aa, Artificial Sequence
  Description of Artificial Sequence: Synthetic coding sequence
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRLRTPSASPLHQE

SEQ ID NO: 13309 - protein, 421 aa, Artificial Sequence
  Description of Artificial Sequence: Synthetic coding sequence
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSNNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 13310 - protein, 397 aa, Artificial Sequence
  Description of Artificial Sequence: Synthetic coding sequence
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQNEGIPDGACSKDSDCHAGEAVTAGNGVKTGRCLRRENLARGTCEIFAWCPLETSSRPEEPFLKEAEDFTIFIKNHIRFPKFNFSNNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 13311 - protein, 362 aa, Artificial Sequence
  Description of Artificial Sequence: Synthetic coding sequence
MPTYRPPSHRWVFLIKKGYQDVDTSLQSAVITKVKGVAFTNTSDLGQRIWDVADYVIPAQNEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 13312 - protein, 431 aa, Artificial Sequence
  Description of Artificial Sequence: Synthetic coding sequence
MGSPGATTGWGLLDYKTEKYVMTRNWRVGALQRLLQFGIVVYVVGWALLAKKGYQERDLEPQFSIITKLKGVSVTQIKELGNRLWDVADFVKPPQGENVFFLVTNFLVTPAQVQGRCPEHPSVPLANCWVDEDCPEGEGGTHSHGVKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 13313 - protein, 70 aa, Artificial Sequence
  Description of Artificial Sequence: Synthetic coding sequence
MGSPGATTGWGLLDYKTEKWALLAKKGYQERDLEPQFSIITKLKGVSVTQIKELGNRLWDVADFVKPPQV

SEQ ID NO: 13314 - protein, 441 aa, Artificial Sequence
  Description of Artificial Sequence: Synthetic coding sequence
MCPQLAGAGSMGSPGATTGWGLLDYKTEKYVMTRNWRVGALQRLLQFGIVVYVVGWALLAKKGYQERDLEPQFSIITKLKGVSVTQIKELGNRLWDVADFVKPPQGENVFFLVTNFLVTPAQVQGRCPEHPSVPLANCWVDEDCPEGEGGTHSHGVKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 13315 - protein, 80 aa, Artificial Sequence
  Description of Artificial Sequence: Synthetic coding sequence
MCPQLAGAGSMGSPGATTGWGLLDYKTEKWALLAKKGYQERDLEPQFSIITKLKGVSVTQIKELGNRLWDVADFVKPPQV

SEQ ID NO: 13316 - protein, 388 aa, Artificial Sequence
  Description of Artificial Sequence: Synthetic coding sequence
MWWALLAKKGYQERDLEPQFSIITKLKGVSVTQIKELGNRLWDVADFVKPPQGENVFFLVTNFLVTPAQVQGRCPEHPSVPLANCWVDEDCPEGEGGTHSHGVKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 13317 - protein, 339 aa, Artificial Sequence
  Description of Artificial Sequence: Synthetic coding sequence
MANLDKYTETFKMGSNSTSTAEIYCNVTNVKFQYSLYATTYILIFIPGLLANSAALWVLCRFISKKNKAIIFMINLSVADLAHVLSLPLRIYYYISHHWPFQRALCLLCFYLKYLNMYASICFLTCISLQRCFFLLKPFRARDWKRRYDVGISAAIWIVVGTACLPFPILRSTDLNNNKSCFADLGYKQMNAVALVGMITVAELAGFVIPVIIIAWCTWKTTISLRQPPMAFQGISERQKALRMVFMCAAVFFICFTPYHINFIFYTMVKETIISSCPVVRIALYFHPFCLCLASLCCLLDPILYYFMASEFRDQLSRHGSSVTRSRLMSKESGSSMIG

SEQ ID NO: 13318 - protein, 339 aa, Artificial Sequence; identical to SEQ ID NO: 13317
  Description of Artificial Sequence: Synthetic coding sequence

SEQ ID NO: 13319 - protein, 354 aa, Artificial Sequence
  Description of Artificial Sequence: Synthetic coding sequence
MTAAIRRQRELSILPKVTLEAMNTTVMQGFNRSERCPRDTRIVQLVFPALYTVVFLTGILLNTLALWVFVHIPSSSTFIIYLKNTLVADLIMTLMLPFKILSDSHLAPWQLRAFVCRFSSVIFYETMYVGIVLLGLIAFDRFLKIIRPLRNIFLKKPVFAKTVSIFIWFFLFFISLPNTILSNKEATPSSVKKCASLKGPLGLKWHQMVNNICQFIFWTVFILMLVFYVVIAKKVYDSYRKSKSKDRKNNKKLEGKVFVVVAVFFVCFAPFHFARVPYTHSQTNNKTDCRLQNQLFIAKETTLFLAATNICMDPLIYIFLCKKFTEKLPCMQGRKTTASSQENHSSQTDNITLG

SEQ ID NO: 13320 - protein, 338 aa, Artificial Sequence
  Description of Artificial Sequence: Synthetic coding sequence
MINSTSTQPPDESCSQNLLITQQIIPVLYCMVFIAGILLNGVSGWIFFYVPSSKSFIIYLKNIVIADFVMSLTFPFKILGDSGLGPWQLNVFVCRVSAVLFYVNMYVSIVFFGLISFDRYYKIVKPLWTSFIQSVSYSKLLSVIVWMLMLLLAVPNIILTNQSVREVTQIKCIELKSELGRKWHKASNYIFVAIFWIVFLLLIVFYTAITKKIFKSHLKSSRNSTSVKKKSSRNIFSIVFVFFVCFVPYHIARIPYTKSQTEAHYSCQSKEILRYMKEFTLLLSAANVCLDPIIYFFLCQPFREILCKKLHIPLKAQNDLDISRIKRGNTTLESTDTL

SEQ ID NO: 13321 - protein, 338 aa, Artificial Sequence; identical to SEQ ID NO: 13320
  Description of Artificial Sequence: Synthetic coding sequence

SEQ ID NO: 13322 - protein, 96 aa, Artificial Sequence
  Description of Artificial Sequence: Synthetic coding sequence
MINSTSTQPPDESCSQNLLITQQIIPVLYCMVFIAGILLNGVSGWIFFYVPSSKSFIIYLKNIVIADFVMSLTFPFKILGDSGLGPWQLNVFVCRV

SEQ ID NO: 13323 - protein, 785 aa, Artificial Sequence
  Description of Artificial Sequence: Synthetic coding sequence
MASKVTDAIVWYQKKEFLSVATTAPGPQQVLPGYCQCSLKDQGLFIQCLIGAYDQQIWEKSVEQREIKFIKLGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 13324 - protein, 695 aa, Artificial Sequence
  Description of Artificial Sequence: Synthetic coding sequence
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQINLYLKMEKKPNKKEELTLVNNVLKLATKLLKELDSPFRLYGLTMNPLLYNITQVVILSAVSGVISDLLGFNLKLWKIKS

SEQ ID NO: 13325 - protein, 747 aa, Artificial Sequence
  Description of Artificial Sequence: Synthetic coding sequence
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 13326 - protein, 751 aa, Artificial Sequence
  Description of Artificial Sequence: Synthetic coding sequence
MASKVTDAIVWYQKKIGAYDQQIWEKSVEQREIKFIKLGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 13327 - protein, 751 aa, Artificial Sequence; identical to SEQ ID NO: 13326
  Description of Artificial Sequence: Synthetic coding sequence

SEQ ID NO: 13328 - protein, 751 aa, Artificial Sequence
  Description of Artificial Sequence: Synthetic coding sequence
MASKVTDAIVWYQKKIGAYDQQIWEKSVEQREIKFIKYGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 13329 - protein, 352 aa, Artificial Sequence
  Description of Artificial Sequence: Synthetic coding sequence
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEVYTLSLSVYIRIYFICY

SEQ ID NO: 13330 - protein, 356 aa, Artificial Sequence
  Description of Artificial Sequence: Synthetic coding sequence
MASKVTDAIVWYQKKIGAYDQQIWEKSVEQREIKFIKLGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEVYTLSLSVYIRIYFICY

SEQ ID NO: 13331 - protein, 482 aa, Artificial Sequence
  Description of Artificial Sequence: Synthetic coding sequence
MARKLSVLEVLLIIFCLIVVTIDILLLLLVLEETSDTSFTPECPEIPQSERIDCTPDQEVTEDICRWQYKCCWSPVADANVPRCFFPWNWGYEASNGHTNTSTGFTAQLKRLPSPSLFGNDVATTLFTAEYQTSNRFHFKITDFNNIRYEVSHENINLVDGIADASNLSYYVEVTDKPFSIKIMRTSNRRVLLDTSIGPLQFAQQYLQLSFRLPSANVYGLGEHVHQQYRHNMTWKTWPIFTRDATPTEGMINLYGAHTFFLCLEDARGSSFGVFLMNSNAMEVTLQPAPAITYRTIGGILDFYVFLGNTPEQVVQEYLELVGRPFFPPYWSLGFQLSRRDYGGINKLKEVVSRNRLAEIPYDVQYSDIDYMDGKKDFTVDEVAYSGLPDFVKELHDNGQKYLIIMNPGISKNSNYEPYNNGSLKRVWILGSNGFAVGEGYPGPTVFPDYTNPVCTEWWTDQVAKFHDHLEFDGVWIVSYYS

SEQ ID NO: 13332 - protein, 646 aa, Artificial Sequence
  Description of Artificial Sequence: Synthetic coding sequence
MFLSISTRLPSQYIYGFGETEHTTFRRNMNWNTWGMFAHDEPPAYKKNSYGVHPYYMALEEDGSAHGVLLLNSNAMDVTLQPTPALTYRTTGGILDFYIVLGPTPELVTQQYTELIGRPAMIPYWALGFHLSRYGYQNDAEISSLYDAMVAAQIPYDVQHVDIDYMNRKLDFTLSANFQNLSLLIEQMKKNGMRFILILDPAISGNETQYLPFIRGQENNVFIKWPDTNDIVWGKVWPDLPNVIVDGSLDHETQVKLYRAYVAFPDFFRNSTAAWWKKEIEELYANPREPEKSLKFDGLWIDMNEPSNFVDGSVRGCSNEMLNNPPYMPYLESRDKGLSSKTLCMESQQILPDSSPVEHYNVHNLYGWSQTRPTYEAVQEVTGQRGVIITRSTFPSSGRWGGHRLGNNTAAWDQLGKSIIGMMEFSLFGIPYTGADICGFFGDAEYEMCVRWMQLGAFYPFSRNHNNIGTRRQDPVAWNSTFEMLSRKVLETRYTLLPYLYTLMHKAHVEGSTVVRPLLHEFTDDRTTWDIDRQFMLGPAILISPVLETSTFEISAYFPRARWYDYSTGTSSTSTGQRKILKAPLDHINLHVRGGYILPWQEPAMNTHSSRQNFMGLIVALDDNGTAEGQVFWDDGQSIVFNTTAM

SEQ ID NO: 13333 - protein, 1126 aa, Artificial Sequence [sequence omitted]

SEQ ID NO: 13334 - protein, 739 aa, Artificial Sequence
  Description of Artificial Sequence: Synthetic coding sequence
MFCCLGYEWLSGGCKTWHSAWVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTALPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 13335 - protein, 1133 aa, Artificial Sequence
  Description of Artificial Sequence: Synthetic coding sequence
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTALPPSADDNIKTPAERLRGPLPPSADDNLKTPSERQLTPLPPSAPPSADDNIKTPAFHPQRMISRHLPSVSSLPFHPQLHPQQMIISRYLLSVCGFRFHHQPMIISRHLPSVSSLPFHPQLHPQQMIISRHLPSVCGGRFHPERMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 13336 - protein, 678 aa, Artificial Sequence
  Description of Artificial Sequence: Synthetic coding sequence
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 13337 - protein, 848 aa, Artificial Sequence
  Description of Artificial Sequence: Synthetic coding sequence
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECLLTPLPPSALPSAPPSADDNLKTRAECLLHPLPPSADDNLKTPSERQLTPLPPSAPPSADDNIKTPAFHPQRMIISRHLPSVSSLPFHPQLHPQQMIISRHLPSVCGGRFHPERMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 13338 - protein, 1010 aa, Artificial Sequence
  Description of Artificial Sequence: Synthetic coding sequence
MHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTALPPSADDNIKTPAERLRGPLPPSADDNLKTPSERQLTPLPPSAPPSADDNIKTPAFHPQRMISRHLPSVSSLPFHPQLHPQQMIISRYLLSVCGFRFHHQPMIISRHLPSVSSLPFHPQLHPQQMIISRHLPSVCGGRFHPERMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGGRFHPQQMIISRHLPSVSSLPFHPQLHPQQMIISRHLPSVCGPLPPSADDNLKTPSERQLTPFPPSAPPSADDNIKTPAERLRERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 13339 - protein, 1133 aa, Artificial Sequence; identical to SEQ ID NO: 13335
  Description of Artificial Sequence: Synthetic coding sequence

SEQ ID NO: 13340 - protein, 235 aa, Artificial Sequence
  Description of Artificial Sequence: Synthetic coding sequence
MPKGRAGSLPTTSIGWRFQLWFLGLTCPERHLARRLKNNSFYPFVQQEPNVFVLEYYLDTLWKGMLLFIISVVLVSFSSLREVQKQETWVFLVYGVGVGLWLVISSLPRRRLVLNHTRGVYHFSIQGRTVCQGPLHLVYVRLALSSDAHGRCFFHLVLGGHRLEPLVLVQLSEHYEQMEYLGRYIARKLNINYFDYLATSYRHVVRHWPPPGAGTVMGKSPMGHKPSSSQSSLEV

SEQ ID NO: 13341 - protein, 235 aa, Artificial Sequence; identical to SEQ ID NO: 13340
  Description of Artificial Sequence: Synthetic coding sequence

SEQ ID NO: 13342 - protein, 59 aa, Artificial Sequence
  Description of Artificial Sequence: Synthetic coding sequence
MTSVSTQLSLVLMSLLLVLPVVEAVEAGDAIALLLGVVLSITGICACLGVYARKRNGQM

SEQ ID NO: 13343 - protein, 59 aa, Artificial Sequence; identical to SEQ ID NO: 13342
  Description of Artificial Sequence: Synthetic coding sequence

SEQ ID NO: 13344 - protein, 59 aa, Artificial Sequence; identical to SEQ ID NO: 13342
  Description of Artificial Sequence: Synthetic coding sequence

SEQ ID NO: 13345 - protein, 296 aa, Artificial Sequence
  Description of Artificial Sequence: Synthetic coding sequence
MARCERLRGAALRDVLGRAQGVLFDCDGVLWNGERAVPGAPELLERLARAGKAALFVSNNSRRARPELALRFARLGFGGLRAEQLFSSALCAARLLRQRLPGPPDAPGAVFVLGGEGLRAELRAAGLRLAGDPSAGDGAAPRVRAVLVGYDEHFSFAKLREACAHLRDPECLLVATDRDPWHPLSDGSRTPGTGSLAAAVETASGRQALVVGKPSPYMFECITENFSIDPARTLMVGDRLETDILFGHRCGMTTVLTLTGVSRLEEAQAYLAAGQHDLVPHYYVESIADLTEGLED

SEQ ID NO: 13346 - protein, 79 aa, Artificial Sequence
  Description of Artificial Sequence: Synthetic coding sequence
MFECITENFSIDPARTLMVGDRLETDILFGHRCGMTTVLTLTGVSRLEEAQAYLAAGQHDLVPHYYVESIADLTEGLED

SEQ ID NO: 13347 - protein, 431 aa, Artificial Sequence
  Description of Artificial Sequence: Synthetic coding sequence
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 13348 - protein, 274 aa, Artificial Sequence
  Description of Artificial Sequence: Synthetic coding sequence
MAASWRLGCDPRLLRYLVGFPGRRSVGLVKGALGWSVSRGANWRWFHSTQWLRGDPIKILMPSLSPTMEEGNIVKWLKKEGEAVSAGDALCEIETDKAVVTLDASDDGILAKIVQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 13349 - protein, 501 aa, Artificial Sequence
  Description of Artificial Sequence: Synthetic coding sequence
MAASWRLGCDPRLLRYLVGFPGRRSVGLVKGALGWSVSRGANWRWFHSTQWLRGDPIKILMPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRGIFTKEDALKLVQLKQTGKITESRPTPAPTATPTAPSPLQATAGPSYPRPVIPPVSTPGQPNAVGTFTEIPASNIRRVIAKRLTESKSTVPHAYATADCDLGAVLKVRQDLVKDDIKVSVNDFIIKAAAVTLKQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 13350 - protein, 486 aa, Artificial Sequence
  Description of Artificial Sequence: Synthetic coding sequence
MQSGGAEGSPGAGRTGRGPGSGKAPPAEISSGAPDFPGGDPIKILMPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRGIFTKEDALKLVQLKQTGKITESRPTPAPTATPTAPSPLQATAGPSYPRPVIPPVSTPGQPNAVGTFTEIPASNIRRVIAKRLTESKSTVPHAYATADCDLGAVLKVRQDLVKDDIKVSVNDFIIKAAAVTLKQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 13351 - protein, 406 aa, Artificial Sequence
  Description of Artificial Sequence: Synthetic coding sequence
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHTLLFGGDTNPVHPKHIGSIDPTCNVADVVKDAYETAKMLCEQYYLVAPELEVEEFNAKAPDKPIQVVYVPSHLFHMLFELFKNSMRATVELYEDRKEGYPAVKTLVTLGKEDLSIKISDLGGGVPLRKIDRLFNYMYSTAPRPSLEPTRAAPLAGFGYGLPISRLYARYFQGDLKLYSMEGVGTDAVIYLKALSSESFERLPVFNKSAWRHYKTTPEADDWSNPSSEPRDASKYKAKQ

SEQ ID NO: 13352 - protein, 415 aa, Artificial Sequence
  Description of Artificial Sequence: Synthetic coding sequence
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHTLLFGGDTNPVHPKHIGSIDPTCNVADVVKDAYETAKMLCEQYYLVAPELEVEEFNAKAPDKPIQVVYVPSHLFHMLFELFKNSMRATVELYEDRKEGYPAVKTLVTLGKEDLSIKISDLGGGVPLRKIDRLFNYMYSTAPRPSLEPTRAAPLAGFGYGLPISRLYARYFQGDLKLYSMEGVGTDAVIYLKALSSESFERLPVFNKSAWRHYKTTPEADDWSNPSSEPRDASKYKAKQDKIKTNRTF

SEQ ID NO: 13353 - protein, 529 aa, Artificial Sequence
  Description of Artificial Sequence: Synthetic coding sequence
MSSTVSYWILNSTRNSIATLQGGRRLYSRYVSNRNKLKWRLFSRVPPTLNSSPCGGFTLCKAYRHTSTEEDDFHLQLSPEQINEVLRAGETTHKILDLESRVPNSVLRFESNQLAANSPVEDRRGVASCLQTNGLMFGIFDGHGGHACAQAVSERLFYYVAVSLMSHQTLEHMEGAMESMKPLLPILHWLKHPGDSIYKDVTSVHLDHLRVYWQELLDLHMEMGLSIEEALMYSFQRLDSDISLEIQAPLEDEVTRNLSLQVAFSGATACMAHVDGIHLHVANAGDCRAILGVQEDNGMWSCLPLTRDHNAWNQAELSRLKREHPESEDRTIIMEDRLLGVLIPCRAFGDVQLKWSKELQRSILERGFNTEALNIYQFTPPHYYTPPYLTAEPEVTYHRLRPQDKFLVLASDGLWDMLSNEDVVRLVVGHLAEADWHKTDLAQRPANLGLMQSLLLQRKASGLHEADQNAATRLIRHAIGNNEYGEMEAERLAAMLTLPEDLARMYRDDITVTVVYFNSESIGAYYKGG

SEQ ID NO: 13354 - protein, 325 aa, Artificial Sequence
  Description of Artificial Sequence: Synthetic coding sequence
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLEWIEMPVMPDISAH

SEQ ID NO: 13355 - protein, 333 aa, Artificial Sequence
  Description of Artificial Sequence: Synthetic coding sequence
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPTAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 13356 - protein, 341 aa, Artificial Sequence
  Description of Artificial Sequence: Synthetic coding sequence
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 13357 - protein, 319 aa, Artificial Sequence
  Description of Artificial Sequence: Synthetic coding sequence
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGKFFSPWG

SEQ ID NO: 13358 - protein, 319 aa, Artificial Sequence
  Description of Artificial Sequence: Synthetic coding sequence
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGMAFPTKG

SEQ ID NO: 13359 - protein, 185 aa, Artificial Sequence
  Description of Artificial Sequence: Synthetic coding sequence
MAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGREVSPAHQYALAGGISFPFFWLAGAGSAVFWVLGATLVVIGSHAAFHQIEAVDGEELQMEPV

SEQ ID NO: 13360 - protein, 653 aa, Artificial Sequence
  Description of Artificial Sequence: Synthetic coding sequence
MALVRGAEPAAGPSRWLPTHVQVTVLRARGLRGKSSGAGSTSDAYTVIQVGREKYSTSVVEKTHGCPEWREECSFELPPGALDGLLRAQEADAGPAPWAASSAAACELVLTTMHRSLIGVDKFLGQATVALDEVFGAGRAQHTQWYKLHSKPGKKEKERGEIEVTIQFTRNNLSASMFDLSMKDKPRSPFSKIRDKMKGKKKYDLESASAILPSSAIEDPDLGSLGKMGKAKGFFLRNKLRKSSLTQSNTSLGSDSTLSSASGSLAYQGPGAELLTRSPSRSSWLSTEGGRDSAQSPKLFTHKRTYSDEANQMRVAPPRALLDLQGHLDAASRSSLCVNGSHIYNEEPQGPVRHRSSISGSLPSSGSLQAVSSRFSEEGPRSTDDTWPRGSRSNSSSEAVLGQEELSAQAKVLAPGASHPGEEEGARLPEGKPVQVATPIVASSEAVAEKEGARKEERKPRMGLFHHHHQGLSRSELGRRSSLGEKGGPILGASPHHSSSGEEKAKSSWFGLREAKDPTQKPSPHPVKPLSAAPVEGSPDRKQSRSSLSIALSSGLEKLKTVTSGSIQPVTQAPQAGQMVDTKRLKDSAVLDQSAKYYHLTHDELISLLLQRERELSQRDEHVQELESYIDRLLVRIMETSPTLLQIPPGPPK

SEQ ID NO: 13361 - protein, 218 aa, Artificial Sequence
  Description of Artificial Sequence: Synthetic coding sequence
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTEIYRIVSQKQIADRAAHDESPGNNVVDISVPPTTDGQKPNKLQCCQNL

SEQ ID NO: 13362 - protein, 208 aa, Artificial Sequence
  Description of Artificial Sequence: Synthetic coding sequence
MAKQYDVLFRLLLIGDSGVGKTCLLCRFTDNEFHSSHISTIGVDFKMKTIEVDGIKVRIQIWDTAGQERYQTITKQYYRRAQGIFLVYDISSERSYQHIMKWVSDVDEVGDATSLPGCGEGASPGKARRGPDGKANASRKLCLPQPWMKTSGTHQKASRRSLLGIRLMRSRNGRWEESKGSSWRRSMAWTSMKQVPAPTSTLKSHSRV

SEQ ID NO: 13363 - protein, 212 aa, Artificial Sequence
  Description of Artificial Sequence: Synthetic coding sequence
MAKQYDVLFRLLLIGDSGVGKTCLLCRFTDNEFHSSHISTIGVDFKMKTIEVDGIKVRIQIWDTAGQERYQTITKQYYRRAQGIFLVYDISSERSYQHIMKWVSDVDEYAPEGVQKILIGNKADEEQKRQVGREQGQQLAKEYGMDFYETSACTNLNIKESFTRLTELVLQAHRKELEGLRMRASNELALAELEEEEGKPEGPANSSKTCWC

SEQ ID NO: 13364 - protein, 264 aa, Artificial Sequence
  Description of Artificial Sequence: Synthetic coding sequence
MHFSSSARAADENFDYLFKIILIGDSNVGKTCVVQHFKSGVYTETQQNTIGVDFTVRSLDIDGKKVKNSSASIITFASIQIHGQTQKMSPQIWTKSSHYLWEPLIWTLLPVLLQMQVWDTAGQERFRTITQSYYRSAHAAIIAYDLTRRSTFESIPHWIHEIEKYGAANVVIMLIGNKCDLWEKRHVLFEDACTLAEKYGLLAVLETSAKESKNIEEVFVLMAKELIARNSLHLYGESALNGLPLDSSPVLMAQGPSEKTHCTC

SEQ ID NO: 13365 - protein, 217 aa, Artificial Sequence
  Description of Artificial Sequence: Synthetic coding sequence
MHFSSSARAADENFDYLFKIILIGDSNVGKTCVVQHFKSGVYTETQQNTIGVDFTVRSLDIDGKKVKMQVWDTAGQERFRTITQSYYRSAHAAIIAYDLTRRSTFESIPHWIHEIEKYGAANVVIMLIGNKCDLWEKRHVLFEDACTLAEKYGLLAVLETSAKESKNIEEVFVLMAKELIARNSLHLYGESALNGLPLDSSPVLMAQGPSEKTHCTC

SEQ ID NO: 13366 - protein, 149 aa, Artificial Sequence
  Description of Artificial Sequence: Synthetic coding sequence
MHFSSSARAADENFDYLFKIILIGDSNVGKTCVVQHFKSGVYTETQQNTIGVDFTVRSLDIDGKKVKMQVWDTAGQERFRTITQSYYRSAHAAIIAYDLTRRSTFESIPHWIHEIEKYGAANVVIMLIGNKCDLWEKRHVLFEDACTLA

SEQ ID NO: 13367 - protein, 217 aa, Artificial Sequence; identical to SEQ ID NO: 13365
  Description of Artificial Sequence: Synthetic coding sequence

SEQ ID NO: 13368 - protein, 234 aa, Artificial Sequence
  Description of Artificial Sequence: Synthetic coding sequence
MRKPDSKIVLLGDMNVGKTSLLQRYMERRFPDTVSTVGGAFYLKQWRSYNISIWDTAGREQFHGLGSMYCRGAAAIILTYDVNHRQSLVELEDRFLGLTDTASKDCLFAIVGNKVDLTEEGALAGQEKEECSPNMDAGDRVSPRAPKQVQLEDAVALYKKILKYKMLDEQDVPAAEQMCFETSAKTGYNVDLLFETLFDLVVPMILQQRAERPSHTVDISSHKPPKRTRSGCCA

SEQ ID NO: 13369 - protein, 218 aa, Artificial Sequence
  Description of Artificial Sequence: Synthetic coding sequence
MTDGDYDYLIKLLALGDSGVGKTTFLYRYTDNKFNPKFITTVGIDFREKRVVYNAQGPNGSSGKAFKVHLQLWDTAGQERFRSLTTAFFRDAMGFLLMFDLTSQQSFLNVRNWMSQLQANAYCENPDIVLIGNKADLPDQREVNERQARELADKYGIPYFETSAATGQNVEKAVETLLDLIMKRMEQCVEKTQIPDTVNGGNSGNLDGEKPPEKKCIC

SEQ ID NO: 13370 - protein, 217 aa, Artificial Sequence
  Description of Artificial Sequence: Synthetic coding sequence
METIWIYQFRLIVIGDSTVGKSCLLHRFTQGRFPGLRSPACDPTVGVDFFSRLLEIEPGKRIKLQLWDTAGQERFRSITRSYYRNSVGGFLVFDITNRRSFEHVKDWLEEAKMYVQPFRIVFLLVGHKCDLASQRQVTREEAEKLSADCGMKYIETSAKDATNVEESFTILTRDIYELIKKGEICIQDGWEGVKSGFVPNTVHSSEEAVKPRKECFC

SEQ ID NO: 13371 - protein, 219 aa, Artificial Sequence
  Description of Artificial Sequence: Synthetic coding sequence
MASAGDTQAGPRDAADQNFDYMFKLLLIGNSSVGKTSFLFRYADDSFTPAFVSTVGIDFKVKTVYRHDKRIKLQIWDTAGQERYRTITTAYYRGAMGFLLMYDIANQESFAAVQDWATQIKTYSWDNAQVILVGNKCDLEDERVVPAEDGRRLADDLGFEFFEASAKENINVKQVFERLVDVICEKMNESLEPSSSSGSNGKGPAVGDAPAPQPSSCSC

SEQ ID NO: 13372 - protein, 277 aa, Artificial Sequence
  Description of Artificial Sequence: Synthetic coding sequence
MSAPGSPDQAYDFLLKFLLVGDRDVGKSEILESLQDGAAESPYSHLGGIDYKTTTILLDGQRVKLKLWDTSGQGRFCTIFRSYSRGAQGVILVYDIANRWSFEGMDRWIKKIEEHAPGVPKILVGNRLHLAFKRQVPREQAQAYAERLGVTFFEVSPLCNFNIIESFTELARIVLLRHRMNWLGRPSKVLSLQDLCCRTIVSCTPVHLVDKLPLPSTLRSHLKSFSMAKGLNARMMRGLSYSLTTSSTHKSSLCKVEIVCPPQSPPKNCTRNSCKIS

SEQ ID NO: 13373 - protein, 277 aa, Artificial Sequence; identical to SEQ ID NO: 13372
  Description of Artificial Sequence: Synthetic coding sequence

SEQ ID NO: 13374 - protein, 278 aa, Artificial Sequence
  Description of Artificial Sequence: Synthetic coding sequence
MSALGSPVRAYDFLLKFLLVGDSDVGKGEILASLQDGAAESPYGHPAGIDYKTTTILLDGRRVKLQLWDTSGQGRFCTIFRSYSRGAQGVILVYDIANRWSFDGIDRWIKEIDEHAPGVPKILVGNRLHLAFKRQVPTEQAQAYAERLGVTFFEVSPLCNFNITESFTELARIVLLRHGMDRLWRPSKVLSLQDLCCRAVVSCTPVHLVDKLPLPIALRSHLKSFSMANGLNARMMHGGSYSLTTSSTHKRSSLRKVKLVRPPQSPPKNCTRNSCKIS

SEQ ID NO: 13375 - protein, 278 aa, Artificial Sequence; identical to SEQ ID NO: 13374
  Description of Artificial Sequence: Synthetic coding sequence

SEQ ID NO: 13376 - protein, 379 aa, Artificial Sequence
  Description of Artificial Sequence: Synthetic coding sequence
EQGLGARAAPLGAGPPPLRSAPQAGHGWGRRAVTMSALGSPVRAYDFLLKFLLVGDSDVGKGEILASLQDGAAESPYGHPAGIDYKTTTILLDGRRVKLQLWDTSGQGRFCTIFRSYSRGAQGVILVYDIANRWSFDGIDRWIKEIDEHAPGVPKILVGNRLHLAFKRQVPTEQAQAYAERLGVTFFEVSPLCNFNITESFTELARIVLLRHGMDRLWRPSKVLSLQDLCCRAVVSCTPVHLVDKLPLPIALRSHLKSFSMANGLNARMMHGGSYSLTTSSTHKRSSLRKVKLVRPPQPPQKLHQKQLQNFLRKALKETRRNLSRRSSALPPAAGGCISDPGSSRRMLLANVCDAFRVMETHYPVGLRISTWMCMKLLF

SEQ ID NO: 13377 - protein, 281 aa, Artificial Sequence
  Description of Artificial Sequence: Synthetic coding sequence
MGSQGSPVKSYDYLLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDEHAPGVPRILVGNRLHLAFKRQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSYSLASGAGGGGSKGNSLKRSKSIRPPQSPPQNCSRSNCKIS

SEQ ID NO: 13378 - protein, 281 aa, Artificial Sequence; identical to SEQ ID NO: 13377
  Description of Artificial Sequence: Synthetic coding sequence

SEQ ID NO: 13379 - protein, 281 aa, Artificial Sequence; identical to SEQ ID NO: 13377
  Description of Artificial Sequence: Synthetic coding sequence

SEQ ID NO: 13380 - protein, 281 aa, Artificial Sequence; identical to SEQ ID NO: 13377
  Description of Artificial Sequence: Synthetic coding sequence

SEQ ID NO: 13381 - protein, 155 aa, Artificial Sequence
  Description of Artificial Sequence: Synthetic coding sequence
MAGPGPGPGDPDEQYDFLFKLVLVGDASVGKTCVVQRFKTGAFSERQGSTIGVDFTMKTLEIQGKRVKLQIWDTAGQERFRTITQSYYRSANGAILAYDITKRSSFLSVPHWIEDVRKYAGSNIVQLLIEMQSCYVAQADLELLASSNPPASTSK

SEQ ID NO: 13382 - protein, 212 aa, Artificial Sequence
  Description of Artificial Sequence: Synthetic coding sequence
MAGPGPGPGDPDEQYDFLFKLVLVGDASVGKTCVVQRFKTGAFSERQGSTIGVDFTMKTLEIQGKRVKLQIWDTAGQERFRTITQSYYRSANGAILAYDITKRSSFLSVPHWIEDVRKYAGSNIVQLLIGNKSDLSELREVSLAEAQSLAEHYDILCAIETSAKDSSNVEEAFLRVATELIMRHGGPLFSEKSPDHIQLNSKDIGEGWGCGC

SEQ ID NO: 13383 - protein, 212 aa, Artificial Sequence; identical to SEQ ID NO: 13382
  Description of Artificial Sequence: Synthetic coding sequence

SEQ ID NO: 13384 - protein, 212 aa, Artificial Sequence; identical to SEQ ID NO: 13382
  Description of Artificial Sequence: Synthetic coding sequence

SEQ ID NO: 13385 - protein, 212 aa, Artificial Sequence; identical to SEQ ID NO: 13382
  Description of Artificial Sequence: Synthetic coding sequence

SEQ ID NO: 13386 - protein, 212 aa, Artificial Sequence; identical to SEQ ID NO: 13382
  Description of Artificial Sequence: Synthetic coding sequence

SEQ ID NO: 13387 - protein, 86 aa, Artificial Sequence
  Description of Artificial Sequence: Synthetic coding sequence
MAGPGPGPGDPDEQYDFLFKLVLVGDASVGKTCVVQRFKTGAFSERQGSTIGVDFTMKTLEIQGKRVKLQIWDTAGQERFRTITQS

SEQ ID NO: 13388 - protein, 207 aa, Artificial Sequence
  Description of Artificial Sequence: Synthetic coding sequence
MAKTYDYLFKLLLIGDSGVGKTCLLFRFSEDAFNTTFISTIGIDFKIRTIELDGKKIKLQIWDTAGQERFRTITTAYYRGAMGIMLVYDITNEKSFDNIKNWIRNIEEHASSDVERMILGNKCDMNDKRQVSKERGEKLAIDYGIKFLETSAKSSANVEEAFFTLARDIMTKLNRKMNDSNSAGAGGPVKITENRSKKTSFFRCSLL

SEQ ID NO: 13389 - protein, 190 aa, Artificial Sequence
  Description of Artificial Sequence: Synthetic coding sequence
MAKTYDYLFKLLLIGDSGVGKTCLLFRFSEDAFNTTFISTIGIDFKIRTIELDGKKIKLQIWDTAGQERFRTITTAYYRGAMGIMLVYDITNEKSFDNIKNWIRNIEEHASSDVERMILGNKCDMNDKRQVSKERGEKLAIDYGIKFLETSAKSSANVEENDSNSAGAGGPVKITENRSKKTSFFRCSLL

SEQ ID NO: 13390 - protein, 321 aa, Artificial Sequence
  Description of Artificial Sequence: Synthetic coding sequence
MKQLPVLEPGDKPRKATWYTLTVPGDSPCARVGHSCSYLPPVGNAKRGKVFIVGGANPNRSFSDVHTMDLETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 13391 - protein, 372 aa, Artificial Sequence
  Description of Artificial Sequence: Synthetic coding sequence
MKQLPVLEPGDKPRKATWYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 13392 - protein, 154 aa, Artificial Sequence
  Description of Artificial Sequence: Synthetic coding sequence
MKQLPVLEPGDKPRKATWYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPAFKSWGFWTVLANPKYHLHSSLMFKPGRGPRQK

SEQ ID NO: 13393 - protein, 154 aa, Artificial Sequence; identical to SEQ ID NO: 13392
  Description of Artificial Sequence: Synthetic coding sequence

SEQ ID NO: 13394 - protein, 372 aa, Artificial Sequence; identical to SEQ ID NO: 13391
  Description of Artificial Sequence: Synthetic coding sequence

SEQ ID NO: 13395 - protein, 244 aa, Artificial Sequence
  Description of Artificial Sequence: Synthetic coding sequence
GRGSPDTGSITVSGRESESFRGVGPSRVQRTGKGLPWLRPGHFDRISLFFPDPVSYPLELPRGDEICWAGSGGCCGRSRPREASLTELWTLGTAVSGLGRRYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPETRTWTTPEVTSPPPSPRTFHTSSAAIGNQLYVFGGGERG

SEQ ID NO: 13396 - protein, 201 aa, Artificial Sequence
  Description of Artificial Sequence: Synthetic coding sequence
MAGKSSLFKVILLGDGGVGKSSLMNRYVTNKFDTQLFHTIGVEFLNKDLEVDGHFVTMQIWDTAGQERFRSLRTPFYRGSDCCLLTFSVDDSQSFQNLSNWKKEFIYYADVKEPESFPFVILGNKIDISERQVSTEEAQAWCRDNGDYPYFETSAKDATNVAAAFEEAVRRVLATEDRSDHLIQTDTVNLHRKPKPSSSCC

SEQ ID NO: 13397 - protein, 501 aa, Artificial Sequence
  Description of Artificial Sequence: Synthetic coding sequence
MGCGLRKLEDPDDSSPGKIFSTLKRPQVETKTEFAYEYVLLDFTLQASSNPEVIKINSILDIVTKVENYYLKGYIVGAIHPVIQPVGQRKHLPASYLYRVVLLRLKLSPKNSAAPSGQRRPRLVIEECPLTSEAQTNDAAKELIEKINVAAKRGMKFVGFISQHYSPSKFCNGTNHDGDIESMLHVRHGSDENCRSWNEGTLSGQSSESGIEEELHHESGQYQMEQNGSPTSSKSRKGEASDNKLYTVFNAFDDDSTSWAYQEGILSMKVTRKGSVISTLDADWLELTTFYYKQGLSLIDSFVFWETSKGEHLPKSLEGFFIYEEEGSGVPGSSRKGNDAIVVEQWTVIEGCEIKTDYGPLLHTLAEFGWLLTSVLPTPVLRHDSEGNLATKQIVFLQRPVMWNSAAQTPDKKASRHIKGEDKNKATSRSIGLDTTSSQPAESRHLPEECRLSPSRECWTKEGRLAQHNSFSGFSSSDNVLRELDDGQFDQEDGVTQVTCM

SEQ ID NO: 13398 - protein, 578 aa, Artificial Sequence
  Description of Artificial Sequence: Synthetic coding sequence
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEMKGPVQEDKGEQLSPGGLLCGVGVEGEAVQNGPASHSRALVGICTGHSNPGEDARDGDAEEVRELGTVEEN

SEQ ID NO: 13399 - protein, 114 aa, Artificial Sequence
  Description of Artificial Sequence: Synthetic coding sequence
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQK

SEQ ID NO: 13400 - protein, 149 aa, Artificial Sequence
  Description of Artificial Sequence: Synthetic coding sequence
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQ

SEQ ID NO: 13401 - protein, 149 aa, Artificial Sequence; identical to SEQ ID NO: 13400
  Description of Artificial Sequence: Synthetic coding sequence

SEQ ID NO: 13402 - protein, 275 aa, Artificial Sequence
  Description of Artificial Sequence: Synthetic coding sequence
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSG

SEQ ID NO: 13403 - protein, 548 aa, Artificial Sequence
  Description of Artificial Sequence: Synthetic coding sequence
MDLMNGQASSVNIAATASEGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLVGPEVGASPQSGRKSVAAEGALLPQTPPSPRNLIPHGHRKCHSLGYNFIHKMNTAEFKSATFPNAGPRHLLDDSVMEPHAPSRGQAESSTLSSGISIGSSDGSELSEETSWPAFERNRLYHSLGPVTRVARNGYRSHMKASSSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRMNAMLWFKHLSAACQSNKQQVPTNLMTFE

SEQ ID NO: 13404 - protein, 557 aa, Artificial Sequence
  Description of Artificial Sequence: Synthetic coding sequence
MDLMNGQASSVNIAATASEKSSSSESLSDKGSELKKSFDAVVFDVLKVTPEEYAGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLVGPEVGASPQSGRKSVAAEGALLPQTPPSPRNLIPHGHRKCHSLGYNFIHKMNTAEFKSATFPNAGPRHLLDDSVMEPHAPSRGQAESSTLSSGISIGSSDGSELSEETSWPAFESSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRMNAMLWFKHLSAACQSNKQQVPTNLMTFE

SEQ ID NO: 13405 - protein, 583 aa, Artificial Sequence
  Description of Artificial Sequence: Synthetic coding sequence
MDLMNGQASSVNIAATASEKSSSSESLSDKGSELKKSFDAVVFDVLKVTPEEYAGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLVGPEVGASPQSGRKSVAAEGALLPQTPPSPRNLIPHGHRKCHSLGYNFIHKMNTAEFKSATFPNAGPRHLLDDSVMEPHAPSRGQAESSTLSSGISIGSSDGSELSEETSWPAFERNRLYHSLGPVTRVARNGYRSHMKASSSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRMNAMLWFKHLSAACQSNKQQVPTNLMTFE

SEQ ID NO: 13406 - protein, 232 aa, Artificial Sequence [sequence omitted]

SEQ ID NO: 13407 - protein, 795 aa, Artificial Sequence
  Description of Artificial Sequence: Synthetic coding sequence
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVDGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 13408 - protein, 769 aa, Artificial Sequence
  Description of Artificial Sequence: Synthetic coding sequence
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 13409 - protein, 744 aa, Artificial Sequence
  Description of Artificial Sequence: Synthetic coding sequence
MELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 13410 - protein, 705 aa, Artificial Sequence
  Description of Artificial Sequence: Synthetic coding sequence
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEDTAIVHPVPIRMTPSKIHMQEMELKRTGSDHTNPTSPLLVKPSDLLEENKINSSVKFASGNTVGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 13411 - protein, 796 aa, Artificial Sequence
  Description of Artificial Sequence: Synthetic coding sequence
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 13412 - protein, 146 aa, Artificial Sequence
  Description of Artificial Sequence: Synthetic coding sequence
ELNQSSEWETFSERSSSSQTLTQFDSNIAPADPDTAIVHPVPIRMTPSKIHMQEMELKRTGSDHTNPTSPLLVKPSDLLEENKINSSVKFASGNTVGQQQAGVVAHPPAVPPRPQPSQAPGPAVHRPVDADGLITHTSTSPQQIPE

SEQ ID NO: 13413 - protein, 465 aa, Artificial Sequence
  Description of Artificial Sequence: Synthetic coding sequence
MTTIPRKGSSHLPGSLHTCKLKLQEDRRQQEKSVIAQPIFVFEKGEQTFKRPAEDTLYEAAEPECNGFPTKRVRSSSFTFHITDSQSQGVRKNNVFMTSALVQSSVDIKSAEQGPVKHSKHVIRPAILQLPQARSCAKVRKTFGHKALESCKTKEKTNNKISEGNSYLLSENLSRARISVQLSTNQDFLGATSVGCQPNEDKCSFKSCSSNFVFGENMVERVLGTQKLTQPQLENDSYAKEKPFKSIPKFPVNFLSSRTDSIKNTSLIESAAAFSSQPSRKCLLEKIDVITGEETEHNVLKINCKLFIFNKTTQSWIERGRGTLRLNDTASTDCGTLQSRLIMRNQGSLRLILNSKLWAQMKIQRANHKNVRITATDLEDYSIKIFLIQASAQDTAYLYAAIHHRLVALQSFNKQRDVNQAESLSETAQQLNCESCDENEDDFIQVTKNGSDPSSWTHRQSVACS

SEQ ID NO: 13414 - protein, 108 aa, Artificial Sequence
  Description of Artificial Sequence: Synthetic coding sequence
MTTIPRKGSSHLPGSLHTCKLKLQEDRRQQEKSVIAQPIFVFEKGEQTFKRPAEDTLYEAAEPECNGFPTKRVRSSSFTFHITDSQSQGVRKNNVFMTSALVQSSVDI

SEQ ID NO: 13415 - protein, 490 aa, Artificial Sequence
  Description of Artificial Sequence: Synthetic coding sequence
MTTIPRKGSSHLPGSLHTCKLKLQEDRRQQEKSVIAQPIFVFEKGEQTFKRPAEDTLYEAAEPECNGFPTKRVRSSSFTFHITDSQSQGVSTLSQKQMRCSSVTNLPTFPHSGPVRKNNVFMTSALVQSSVDIKSAEQGPVKHSKHVIRPAILQLPQARSCAKVRKTFGHKALESCKTKEKTNNKISEGNSYLLSENLSRARISVQLSTNQDFLGATSVGCQPNEDKCSFKSCSSNFVFGENMVERVLGTQKLTQPQLENDSYAKEKPFKSIPKFPVNFLSSRTDSIKNTSLIESAAAFSSQPSRKCLLEKIDVITGEETEHNVLKINCKLFIFNKTTQSWIERGRGTLRLNDTASTDCGTLQSRLIMRNQGSLRLILNSKLWAQMKIQRANHKNVRITATDLEDYSIKIFLIQASAQDTAYLYAAIHHRLVALQSFNKQRDVNQAESLSETAQQLNCESCDENEDDFIQVTKNGSDPSSWTHRQSVACS

SEQ ID NO: 13416 - protein, 1499 aa, Artificial Sequence
  Description of Artificial Sequence: Synthetic coding sequence
MKPLAIPANHGVMGQQEKHSLPADFTKLHLTDSLHPQVTHVSSSHSGCSITSDSGSSSLSDIYQATESEAGDMDLSGLPETAVDSEDDDDEEDIERASDPLMSRDIVRDCLEKDPIDRTDDDIEQLLEFMHQLPAFANMTMSVRRELCAVMVFAVVERAGTIVLNDGEELDSWSVILNGSVEVTYPDGKAEILCMGNSFGVSPTMDKEYMKGVMRTKVDDCQFVCIAQQDYCRILNQVEKNMQKVEEEGEIVMVKEHRELDRTGTRKGHIVIKGTSERLTMHLVEEHSVVDPTFIEDFLLTYRTFLSSPMEVGKKLLEWFNDPSLRDKVTRVVLLWVNNHFNDFEGDPAMTRFLEEFENNLEREKMGGHLRLLNIACAAKAKRRLMTLTKPSREAPLPFILLGGSEKGFGIFVDSVDSGSKATEAGLKRGDQILEVNGQNFENIQLSKAMEILRNNTHLSITVKTNLFVFKELLTRLSEEKRNGAPHLPKIGDIKKASRYSIPDLAVDVEQVIGLEKVNKKSKANTVGGRNKLKKILDKTRISILPQKPYNDIGIGQSQDDSIVGLRQTKHIPTALPVSGTLSSSNPDLLQSHHRILDFSATPDLPDQVLRVFKADQQSRYIMISKDTTAKEVVIQAIREFAVTATPDQYSLCEVSVTPEGVIKQRRLPDQLSKLADRIQLSGRYYLKNNMETETLCSDEDAQELLRESQISLLQLSTVEVATQLSMRNFELFRNIEPTEYIDDLFKLRSKTSCANLKRFEEVINQETFWVASEILRETNQLKRMKIIKHFIKIALHCRECKNFNSMFAIISGLNLAPVARLRTTWEKLPNKYEKLFQDLQDLFDPSRNMAKYRNVLNSQNLQPPIIPLFPVIKKDLTFLHEGNDSKVDGLVNFEKLRMIAKEIRHVGRMASVNMDPALMFRTRKKKWRSLGSLSQGSTNATVLDVAQTGGHKKRVRRSSFLNAKKLYEDAQMARKVKQYLSNLELEMDEESLQTLSLQCEPATNTLPKNPGDKKPVKSETSPVAPRAGSQQKAQSLPQPQQQPPPAHKINQGLQVPAVSLYPSRKKVPVKDLPPFGINSPQALKKILSLSEEGSLERHKKQAEDTISNASSQLSSPPTSPQSSPRKGYTLAPSGTVDNFSDSGHSEISSRSSIVSNSSFDSVPVSLHDERRQRHSVSIVETNLGMGRMERRTMIEPDQYSLGSYAPMSEGRGLYATATVISSPSTEELSQDQGDRASLDAADSGRGSWTSCSSGSHDNIQTIQHQRSWETLPFGHTHFDYSGDPAGLWASSSHMDQIMFSDHSTKYNRQNQSRESLEQAQSRASWASSTGYWGEDSEGDTGTIKRRGGKDVSIEAESSSLTSVTTEETKPVPMPAHIAVASSTTKGLIARKEGRYREPPPTPPGYIGIPITDFPEGHSHPARKPPDYNVALQRSRMVARSSDTAGPSSVQQPHGHPTSSRPVNKPQWHKPNESDPRLAPYQSQGFSTEEDEDEQVSAV

SEQ ID NO: 13417 - protein, 881 aa, Artificial Sequence
  Description of Artificial Sequence: Synthetic coding sequence
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 13418 - protein, 881 aa, Artificial Sequence; identical to SEQ ID NO: 13417
  Description of Artificial Sequence: Synthetic coding sequence

SEQ ID NO: 13419 - protein, 923 aa, Artificial Sequence
  Description of Artificial Sequence: Synthetic coding sequence
MKVGWPGESCWQVGLAVEDSPALGAPRVGALPDVVPEGTLLNMVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 13420 - protein, 598 aa, Artificial Sequence
  Description of Artificial Sequence: Synthetic coding sequence
MKVGWPGESCWQVGLAVEDSPALGAPRVGALPDVVPEGTLLNMVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKVSAWPQFLSSAPPGLQAPPSPPDPEGLCGRGKLSSHRHTLGSLIGVHGALAACGALGQAVPGGAEA

SEQ ID NO: 13421 - protein, 868 aa, Artificial Sequence
  Description of Artificial Sequence: Synthetic coding sequence
MAQREEIKRPLWETVGWPGESCWQVGLAVEDSPALGAPRVGALPDVVPEGTLLNMVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 13422 - protein, 881 aa, Artificial Sequence; identical to SEQ ID NO: 13417
  Description of Artificial Sequence: Synthetic coding sequence

SEQ ID NO: 13423 - protein, 923 aa, Artificial Sequence; identical to SEQ ID NO: 13419
  Description of Artificial Sequence: Synthetic coding sequence

SEQ ID NO: 13424 - protein, 223 aa, Artificial Sequence
  Description of Artificial Sequence: Synthetic coding sequence
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEP

SEQ ID NO: 13425 - protein, 141 aa, Artificial Sequence
  Description of Artificial Sequence: Synthetic coding sequence
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYR

SEQ ID NO: 13426 - protein, 570 aa, Artificial Sequence
  Description of Artificial Sequence: Synthetic coding sequence
MRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 13427 - protein, 881 aa, Artificial Sequence; identical to SEQ ID NO: 13417
  Description of Artificial Sequence: Synthetic coding sequence

SEQ ID NO: 13428 - protein, 1010 aa, Artificial Sequence
  Description of Artificial Sequence: Synthetic coding sequence
MVAAHAAHSSSSAEWIACLDKRPLERSSEDVDIIFTRLKEVKAFEKFHPNLLHQICLCGYYENLEKGITLFRQGDIGTNWYAVLAGSLDVKVSETSSHQDAVTICTLGIGTAFGESILDNTPRHATIVTRESSELLRIEQKDFKALWEKYRQYMAGLLAPPYGVMETGSNNDNIFKEMTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 13429 - protein, 1011 aa, Artificial Sequence
  Description of Artificial Sequence: Synthetic coding sequence
MVAAHAAHSSSSAEWIACLDKRPLERSSEDVDIIFTRLKEVKAFEKFHPNLLHQICLCGYYENLEKGITLFRQGDIGTNWYAVLAGSLDVKVSETSSHQDAVTICTLGIGTAFGESILDNTPRHATIVTRESSELLRIEQKDFKALWEKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 13430 - protein, 867 aa, Artificial Sequence
  Description of Artificial Sequence: Synthetic coding sequence
MLYKKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 13431 - protein, 943 aa, Artificial Sequence
  Description of Artificial Sequence: Synthetic coding sequence
MVAAHAAHSSSSAEWIACLDKRPLERSSEDVDIIFTRLKEVKAFEKFHPNLLHQICLCGYYENLEKGITLFRQGDIGTNWYAVLAGSLDVKVSETSSHQDAVTICTLGIGTAFGESILDNTPRHATIVTRESSELLRIEQKDFKALWEKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWERMIANTARTVRYYRSQPFNPDAAQANKNHQDVRSYVRQLNVIDNQRTLSQMSHRLEPRRP

SEQ ID NO: 13432 - protein, 791 aa, Artificial Sequence
  Description of Artificial Sequence: Synthetic coding sequence
MIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 13433 - protein, 840 aa, Artificial Sequence
  Description of Artificial Sequence: Synthetic coding sequence
MAGLLAPPYGVMETGSNNDRIPDKENVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 13434 - protein, 858 aa, Artificial Sequence
  Description of Artificial Sequence: Synthetic coding sequence
MAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 13435 - protein, 399 aa, Artificial Sequence
  Description of Artificial Sequence: Synthetic coding sequence
MFVFVLTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSRYRTGENGLCPQQ

SEQ ID NO: 13436 - protein, 858 aa, Artificial Sequence; identical to SEQ ID NO: 13434
  Description of Artificial Sequence: Synthetic coding sequence

SEQ ID NO: 13437 - protein, 183 aa, Artificial Sequence
  Description of Artificial Sequence: Synthetic coding sequence
MREYKVVVLGSGGVGKSALTVQFVTGSFIEKYDPTIEDFYRKEIEVDSSPSVLEILDTAGTEQFASMRDLYIKNGQGFILVYSLVNQQSFQDIKPMRDQIIRVKRYERVPMILVGNKVDLEGEREVSYGEGKALAEEWSCPFMETSAKNKASVDELFAEIVRQMNYAAQPNGDEGCCSACVIL

SEQ ID NO: 13438 - protein, 183 aa, Artificial Sequence
  Description of Artificial Sequence: Synthetic coding sequence
MREYKVVVLGSGGVGKSALTVQFVTGTFIEKYDPTIEDFYRKEIEVDSSPSVLEILDTAGTEQFASMRDLYIKNGQGFILVYSLVNQQSFQDIKPMRDQIVRVKRYEKVPLILVGNKVDLEPEREVMSSEGRALAQEWGCPFMETSAKSKSMVDELFAEIVRQMNYSSLPEKQDQCCTTCVVQ

SEQ ID NO: 13439 - protein, 183 aa, Artificial Sequence; identical to SEQ ID NO: 13438
  Description of Artificial Sequence: Synthetic coding sequence

SEQ ID NO: 13440 - protein, 340 aa, Artificial Sequence
  Description of Artificial Sequence: Synthetic coding sequence
MHTDLDTDMDMDTETTALCPSGSRRASPPGTPTPEADATLLKKSEKLLAELDRSGLPSAPGAPRRRGSMPVPYKHQLRRAQAVDELDWPPQASSSGSSDSLGSGEAAPAQKDGIFKVMLVGESGVGKSTLAGTFGGLQGDSAHEPENPEDTYERRIMVDKEEVTLVVYDIWEQGDAGGWLRDHCLQTGDAFLIVFSVTDRRSFSKVPETLLRLRAGRPHHDLPVILVGNKSDLARSREVSLEEGRHLAGTLSCKHIETSAALHHNTRELFEGAVRQIRLRRGRNHAGGQRPDPGSPEGPAPPARRESLTKKAKRFLANLVPRNAKFFKQRSRSCHDLSVL

SEQ ID NO: 13441 - protein, 221 aa, Artificial Sequence
  Description of Artificial Sequence: Synthetic coding sequence
MHTDLDTDMDMDTETTALCPSGSRRASPPGTPTPEADATLLKKSEKLLAELDRSGLPSAPGAPRRRGSMPVPYKHQLRRAQAVDELDWPPQASSSGSSDSLGSGEAAPAQKDGIFKVMLVGESGVGKSTLAGTFGGLQGDSAHEPENPGGCRRVAAGPLPSDRGRLSHRLLSHRPTEFLQSSRDPTSAPGWEAAPRPTRYPRWKQERLGPLPGGITGGCVS

SEQ ID NO: 13442 - protein, 298 aa, Artificial Sequence
  Description of Artificial Sequence: Synthetic coding sequence
MTLNTEQEAKTPLHRRASTPLPLSPRGHQPGRLSTVPSTQSQHPRLGQSASLNPPTQKPSPAPDDWSSESSDSEGSWEALYRVVLLGDPGVGKTSLASLFAGKQERDLHEQLGEDVYERTLTVDGEDTTLVVVDTWEAEKLDKSWSQESCLQGGSAYVIVYSIADRGSFESASELRIQLRRTHQADHVPIILVGNKADLARCREVSVEEGRACAVVFDCKFIETSATLQHNVAELFEGVVRQLRLRRRDSAAKEPPAPRRPASLAQRARRFLARLTARSARRRALKARSKSCHNLAVL

SEQ ID NO: 13443 - protein, 783 aa, Artificial Sequence
  Description of Artificial Sequence: Synthetic coding sequence
MESPGESGAGSPGAPSPSSFTTGHLAREKPAQDPLYDVPNASGGQAGGPQRPGRVVSLRERLLLTRPVWLQLQANAAAALHMLRTEPPGTFLVRKSNTRQCQALCMRLPEASGPSFVSSHYILESPGGVSLEGSELMFPDLVQLICAYCHTRDILLLPLQLPRAIHHAATHKELEAISHLGIEFWSSSLNIKAQRGPAGGPVLPQLKARSPQELDQGTGAALCFFNPLFPGDLGPTKREKFKRSFKVRVSTETSSPLSPPAVPPPPVPVLPGAVPSQTERLPPCQLLRRESSVGYRVPAGSGPSLPPMPSLQEVDCGSPSSSEEEGVPGSRGSPATSPHLGRRRPLLRSMSAAFCSLLAPERQVGRAAAALMQDRHTAAGQLVQDLLTQVRAGPEPQELQGIRQALSRARAMLSAELGPEKLLSPKRLEHVLEKSLHCSVLKPLRPILAARLRRRLAADGSLGRLAEGLRLARAQGPGAFGSHLSLPSPVELEQVRQKLLQLLRTYSPSAQVKRLLQACKLLYMALRTQEGEGAGADEFLPLLSLVLAHCDLPELLLEAEYMSELLEPSLLTGEGGYYLTSLSASLALLSGLGQAHTLPLSPVQELRRSLSLWEQRRLPATHCFQHLLRVAYQDPSSGCTSKTLAVPPEASIATLNQLCATKFRVTQPNTFGLFLYKEQGYHRLPPGALAHRLPTTGYLVYRRAEWPETQGAVTEEEGSGQSEARSRGEEQGCQGDGDAGVKASPRDIREQSETTAEGGQGQAQEGPAQPGEPEAEGSRAAEE

SEQ ID NO: 13444 - protein, 605 aa, Artificial Sequence
  Description of Artificial Sequence: Synthetic coding sequence
MRLPEASGPSFVSSHYILESPGGVSLEGSELMFPDLVQLICAYCHTRDILLLPLQLPRAIHHAATHKELEAISHLGIEFWSSSLNIKAQRGPAGGPVLPQLKARSPQELDQGTGAALCFFNPLFPGDLGPTKREKFKRSFKVRVSTETSSPLSPPAVPPPPVPVLPGAVPSQTERLPPCQLLRRESSVGYRVPAGSGPSLPPMPSLQEVDCGSPSSSEEEGVPGSRGSPATSPHLGRRRPLLRSMSAAFCSLLAPERQVGRAAAALMQDRHTAAGQLVQDLLTQVRAGPEPQELQGIRQALSRARAMLSAELGPEKLLSPKRLEHVLEKSLHCSVLKPLRPILAARLRRRLAADGSLGRLAEGLRLARAQGPGAFGSHLSLPSPVELEQVRQKLLQLLRTYSPSAQVKRLLQACKLLYMALRTQEGEGAGADEFLPLLSLVLAHCDLPELLLEAEYMSELLEPSLLTGEGGYYLTSLSASLALLSGLGQAHTLPLSPVQELRRSLSLWEQRRLPATHCFQHLLRVAYQDPSSGCTSKTLAVPPEASIATLNQLCATKFRVTQPNTFGLFLQGNQRQREAGQQRSSLKWPEGSFGAGDPEPAEKSF

SEQ ID NO: 13445 - protein, 644 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHAISLRCSSKQAKRHIDFTEEQAELTPHSYLDRETSLLLRNIAGKPSHLLTKEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSK

SEQ ID NO: 13446 - protein, 1250 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKARMESMNRPYTSLVPPLSPQPKIVTPYTASQPSPPLPPPPPPPPPPPPPPPPPPPPLPSQSAPSAGSAAPMFVKYSTITRLQNASQHSGALFKPPTPPVMQSQSVKPQILVPPNGVVPPPPPPPPPPTPGSAMAQLKPAPCAPSLPQFSAPPPPLKIHQVQHITQVAPPTPPPPPPIPAPLPPQAPPKPLVTIPAPTSTKTVAPVVTQAAPPTPTPPVPPAKKQPAFPASYIPPSPPTPPVPVPPPTLPKQQSFCAKPPPSPLSPVPSVVKQIASQFPPPPTPPAMESQPLKPVPANVAPQSPPAVKAKPKWQPSSIPVPSPDFPPPPPESSLVFPPPPPSPVPAPPPPPPPTASPTPDKSGSPGKKTSKTSSPGGKKPPPTPQRNSSIKSSSGAEHPEPKRPSVDSLVSKFTPPAESGSPSKETLPPPAAPPKPGKLNLSGVNLPGVLQQGCVSAKAPVLSGRGKDSVVEFPSPPSDSDFPPPPPETELPLPPIEIPAVFSGNTSPKVAVVNPQPQQWSKMSVKKAPPPTRPKRNDSTRLTQAEISEQPTMATVVPQVPTSPKSSLSVQPGFLADLNRTLQRKSITRHGSLSSRMSRAEPTATMDDMALPPPPPELLSDQQKAGYGGSHISGYATLRRGPPPAPPKRDQNTKLSRDW

SEQ ID NO: 13447 - protein, 617 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHSYLDRETSLLLRNIAGKPSHLLTKEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSK

SEQ ID NO: 13448 - protein, 619 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHAISLRCSSKQAKRHIDFTEEQAELTPEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSK

SEQ ID NO: 13449 - protein, 1302 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHAISLRCSSKQAKRHIDFTEEQAELTPHSYLDRETSLLLRNIAGKPSHLLTKEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKARMESMNRPYTSLVPPLSPQPKIVTPYTASQPSPPLPPPPPPPPPPPPPPPPPPPPLPSQSAPSAGSAAPMFVKYSTITRLQNASQHSGALFKPPTPPVMQSQSVKPQILVPPNGVVPPPPPPPPPPTPGSAMAQLKPAPCAPSLPQFSAPPPPLKIHQVQHITQVAPPTPPPPPPIPAPLPPQAPPKPLVTIPAPTSTKTVAPVVTQAAPPTPTPPVPPAKKQPAFPASYIPPSPPTPPVPVPPPTLPKQQSFCAKPPPSPLSPVPSVVKQIASQFPPPPTPPAMESQPLKPVPANVAPQSPPAVKAKPKWQPSSIPVPSPDFPPPPPESSLVFPPPPPSPVPAPPPPPPPTASPTPDKSGSPGKKTSKTSSPGGKKPPPTPQRNSSIKSSSGAEHPEPKRPSVDSLVSKFTPPAESGSPSKETLPPPAAPPKPGKLNLSGVNLPGVLQQGCVSAKAPVLSGRGKDSVVEFPSPPSDSDFPPPPPETELPLPPIEIPAVFSGNTSPKVAVVNPQPQQWSKMSVKKAPPPTRPKRNDSTRLTQAEISEQPTMATVVPQVPTSPKSSLSVQPGFLADLNRTLQRKSITRHGSLSSRMSRAEPTATMDDMALPPPPPELLSDQQKAGYGGSHISGYATLRRGPPPAPPKRDQNTKLSRDW

SEQ ID NO: 13450 - protein, 624 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHAISLRCSSKQAKRHIDFTEEQAELTPEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKVTASF

SEQ ID NO: 13451 - protein, 597 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKVTASF

SEQ ID NO: 13452 - protein, 592 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSK

SEQ ID NO: 13453 - protein, 89 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNALNQGETVDLDALM

SEQ ID NO: 13454 - protein, 619 aa, Artificial Sequence; identical to SEQ ID NO: 13448
  Description of Artificial Sequence: Synthetic coding sequence

SEQ ID NO: 13455 - protein, 172 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQ

SEQ ID NO: 13456 - protein, 622 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHSYLDRETSLLLRNIAGKPSHLLTKEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKVTASF

SEQ ID NO: 13457 - protein, 617 aa, Artificial Sequence; identical to SEQ ID NO: 13447
  Description of Artificial Sequence: Synthetic coding sequence

SEQ ID NO: 13458 - protein, 649 aa, Artificial Sequence
  Description of Artificial Sequence: Synthetic coding sequence
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHAISLRCSSKQAKRHIDFTEEQAELTPHSYLDRETSLLLRNIAGKPSHLLTKEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKVTASF

SEQ ID NO: 13459 - protein, 690 aa, Artificial Sequence
  Description of Artificial Sequence: Synthetic coding sequence
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRISFTDYQSYVIHGCLENNPTLERSIALFNGISKWVQLMVLSKPTPQQRAEVITKFINVAKKLLQLKNFNTLMAVVGGLSHSSISRLKETHSHLSSEVTKNWNEMTELVSSNGNYCNYRKAFADCDGFKIPILGVHLKDLIAVHVIFPDWTEENKVNIVKMHQLSVTLSELVSLQNASHHLEPNMDLINLLTLSLDLYHTEDDIYKLSLVLEPRNSKSQPTSPTTPNKPVVPLEWALGVMPKPDPTVINKHIRKLVESVFRNYDHDHDGYISQEDFESIAANFPFLDSFCVLDKDQDGLISKDEMMAYFLRAKSQLHCKMGPGFIHNFQEMTYLKPTFCEHCAGFLWGIIKQGYKCKDCGANCHKQCKDLLVLACRRFARAPSLSSGHGSLPGSPSLPPAQDEVFEFPGVTAGHRDLDSRAITLVTGSSRKISVRLQRATTSQATQTEPVWSEAGWGDSGSHTFPKMKSKFHDKAAKDKGFAKWENEKPRVHAGVDVVDRGTEFELDQDEGEETRQDGEDG

SEQ ID NO: 13460 - protein, 690 aa, Artificial Sequence; identical to SEQ ID NO: 13459
  Description of Artificial Sequence: Synthetic coding sequence

SEQ ID NO: 13461 - protein, 689 aa, Artificial Sequence
  Description of Artificial Sequence: Synthetic coding sequence
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRISFTDYQSYVIHGCLENNPTLERSIALFNGISKWVQLMVLSKPTPQQRAEVITKFINVAKKLLQLKNFNTLMAVVGGLSHSSISRLKETHSHLSSEVTKNWNEMTELVSSNGNYCNYRKAFADCDGFKIPILGVHLKDLIAVHVIFPDWTEENKVNIVKMHQLSVTLSELVSLQNASHHLEPNMDLINLLTLSLDLYHTEDDIYKLSLVLEPRNSKSPTSPTTPNKPVVPLEWALGVMPKPDPTVINKHIRKLVESVFRNYDHDHDGYISQEDFESIAANFPFLDSFCVLDKDQDGLISKDEMMAYFLRAKSQLHCKMGPGFIHNFQEMTYLKPTFCEHCAGFLWGIIKQGYKCKDCGANCHKQCKDLLVLACRRFARAPSLSSGHGSLPGSPSLPPAQDEVFEFPGVTAGHRDLDSRAITLVTGSSRKISVRLQRATTSQATQTEPVWSEAGWGDSGSHTFPKMKSKFHDKAAKDKGFAKWENEKPRVHAGVDVVDRGTEFELDQDEGEETRQDGEDG

SEQ ID NO: 13462 - protein, 113 aa, Artificial Sequence
  Description of Artificial Sequence: Synthetic coding sequence
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEK

SEQ ID NO: 13463 - protein, 34 aa, Artificial Sequence
  Description of Artificial Sequence: Synthetic coding sequence
MGSSGLGKAATLDELLCTCIEMFDDNGELDNSYL

SEQ ID NO: 13464 - protein, 172 aa, Artificial Sequence
  Description of Artificial Sequence: Synthetic coding sequence
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRIS

SEQ ID NO: 13465 - protein, 77 aa, Artificial Sequence
  Description of Artificial Sequence: Synthetic coding sequence
MGSSGLGKAATLDELLCTCIEMFDDNGELDNSYLPRIVLLMHRWYLSSTELAEKLLCMYRNATGESCNEFRLKICYF

SEQ ID NO: 13466 - protein, 112 aa, Artificial Sequence
  Description of Artificial Sequence: Synthetic coding sequence
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYE

SEQ ID NO: 13467 - protein, 183 aa, Artificial Sequence
  Description of Artificial Sequence: Synthetic coding sequence
MPLVRYRKVVILGYRCVGKTSLAHQFVEGEFSEGYDPTVENTYSKIVTLGKDEFHLHLVDTAGQDEYSILPYSFIIGVHGYVLVYSVTSLHSFQVIESLYQKLHEGHGKTRVPVVLVGNKADLSPEREVQAVEGKKLAESWGATFMESSARENQLTQGIFTKVIQEIARVENSYGQERRCHLM

SEQ ID NO: 13468 - protein, 210 aa, Artificial Sequence [sequence omitted]

SEQ ID NO: 13469 - protein, 211 aa, Artificial Sequence
  Description of Artificial Sequence: Synthetic coding sequence
MDAPGALAQTAAPGPGRKELKIVIVGDGGCGKTSLLMVYSQGSFPEHYAPSVFEKYTASVTVGSKEVTLNLYDTAGQEDYDRLRPLSYQNTHLVLICYDVMNPTSYDNVLIKWFPEVTHFCRGIPMVLIGCKTDLRKDKEQLRKLRAAQLEPITYMQGLSACEQIRAALYLECSAKFRENVEDVFREAAKVALSALKKAQRQKKRRLCLLL

SEQ ID NO: 13470 - protein, 113 aa, Artificial Sequence
  Description of Artificial Sequence: Synthetic coding sequence
MDAPGALAQTAAPGPGRKELKIVIVGDGGCGKTSLLMVYSQGSFPEHYAPSVFEKYTASVTVGSKEVTLNLYDTAGQEDYDRLRPLSYQNTHLVLICYDVMNPTSYDNVLIKV

SEQ ID NO: 13471 - protein, 191 aa, Artificial Sequence
  Description of Artificial Sequence: Synthetic coding sequence
MQSIKCVVVGDGAVGKTCLLICYTTNAFPKEYIPTVFDNYSAQSAVDGRTVNLNLWDTAGQEEYDRLRTLSYPQTNVFVICFSIASPPSYENVRHKWHPEVCHHCPDVPILLVGTKKDLRAQPDTLRRLKEQGQAPITPQQGQALAKQIHAVRYLECSALQQDGVKEVFAEAVRAVLNPTPIKRGRSCILL

SEQ ID NO: 13472 - protein, 191 aa, Artificial Sequence; identical to SEQ ID NO: 13471
  Description of Artificial Sequence: Synthetic coding sequence

SEQ ID NO: 13473 - protein, 191 aa, Artificial Sequence; identical to SEQ ID NO: 13471
  Description of Artificial Sequence: Synthetic coding sequence

SEQ ID NO: 13474 - protein, 191 aa, Artificial Sequence; identical to SEQ ID NO: 13471
  Description of Artificial Sequence: Synthetic coding sequence

SEQ ID NO: 13475 - protein, 191 aa, Artificial Sequence
  Description of Artificial Sequence: Synthetic coding sequence
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIRSNLPCTPVLVVATQTDQREMGPHRASCVNAMEGKKLAQDVRAKGYLECSALSNRGVQQVFECAVRTAVNQARRRNRRRLFSINECKIF

SEQ ID NO: 13476 - protein, 103 aa, Artificial Sequence
  Description of Artificial Sequence: Synthetic coding sequence
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIR

SEQ ID NO: 13477 - protein, 191 aa, Artificial Sequence; identical to SEQ ID NO: 13475
  Description of Artificial Sequence: Synthetic coding sequence

SEQ ID NO: 13478 - protein, 109 aa, Artificial Sequence
  Description of Artificial Sequence: Synthetic coding sequence
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIRSNLPCT

SEQ ID NO: 13479 - protein, 16 aa, Artificial Sequence
  Description of Artificial Sequence: Synthetic coding sequence
MLSSIKCVLVGDSAVG

SEQ ID NO: 13480 - protein, 6 aa, Artificial Sequence
  Description of Artificial Sequence: Synthetic coding sequence
MLSSIK

SEQ ID NO: 13481 - protein, 214 aa, Artificial Sequence
  Description of Artificial Sequence: Synthetic coding sequence
MNCKEGTDSSCGCRGNDEKKMLKCVVVGDGAVGKTCLLMSYANDAFPEEYVPTVFDHYAVTVTVGGKQHLLGLYDTAGQEDYNQLRPLSYPNTDVFLICFSVVNPASYHNVQEEWVPELKDCMPHVPYVLIGTQIDLRDDPKTLARLLYMKEKPLTYEHGVKLAKAIGAQCYLECSALTQKGLKAVFDEAILTIFHPKKKKKRCSEGHSCCSII

SEQ ID NO: 13482 - protein, 205 aa, Artificial Sequence
  Description of Artificial Sequence: Synthetic coding sequence
MAHGPGALMLKCVVVGDGAVGKTCLLMSYANDAFPEEYVPTVFDHYAVSVTVGGKQYLLGLYDTAGQEDYDRLRPLSYPMTDVFLICFSVVNPASFQNVKEEWVPELKEYAPNVPFLLIGTQIDLRDDPKTLARLNDMKEKPICVEQGQKLAKEIGACCYVECSALTQKGLKTVFDEAIIAILTPKKHTVKKRIGSRCINCCLIT

SEQ ID NO: 13483 - protein, 236 aa, Artificial Sequence
  Description of Artificial Sequence: Synthetic coding sequence
MPPRELSEAEPPPLRAPTPPPRRRSAPPELGIKCVLVGDGAVGKSSLIVSYTCNGYPARYRPTALDTFSVQVLVDGAPVRIELWDTAGQEDFDRLRSLCYPDTDVFLACFSVVQPSSFQNITEKWLPEIRTHNPQAPVLLVGTQADLRDDVNVLIQLDQGGREGPVPQPQAQGLAEKIRACCYLECSALTQKNLKEVFDSAILSAIEHKARLEKKLNAKGVRTLSRCRWKKFFCFV

SEQ ID NO: 13484 - protein, 85 aa, Artificial Sequence
  Description of Artificial Sequence: Synthetic coding sequence
MAVEEELKKDHAEMQAVIDAKQKIIDAQVINGDEIIQTGKTDRVPGFSQHQTDERADPSEGAVQHAGPQWHLPHQPHQAFHHGEW

SEQ ID NO: 13485 - protein, 1280 aa, Artificial Sequence
  Description of Artificial Sequence: Synthetic coding sequence
MELSPSSGGAAEALSWPEMFPALESDSPLPPEDLDAVVPVSGAVAGGMLDRILLESVCQQQSWVRVYDVKGPPTHRLSCGQSPYTETTTWERKYCILTDSQLVLLNKEKEIPVEGGQEQQTDSTKGRCLRRTVSVPSEGQFPEYPPEGATKLEVPAERSPRRRSISGTSTSEKPNSMDTANTSPFKVPGFFSKRLKGSIKRTKSQSKLDRNTSFRLPSLRSTDDRSRGLPKLKESRSHESLLSPCSTVECLDLGRGEPVSVKPLHSSILGQDFCFEVTYLSGSKCFSCNSASERDKWMENLRRTVQPNKDNCRRAENVLRLWIIEAKDLAPKKKYFCELCLDDTLFARTTSKTKADNIFWGEHFEFFSLPPLHSITVHIYKDVEKKKKKDKNNYVGLVNIPTASVTGRQFVEKWYPVSTPTPNKGKTGGPSIRIKSRFQTITILPMEQYKEFAEFVTSNYTMLCSVLEPVISVRNKEELACALVHILQSTGRAKDFLTDLVMSEVDRCGEHDVLIFRENTIATKSIEEYLKLVGQQYLHDALGEFIKALYESDENCEVDPSKCSSSELIDHQSNLKMCCELAFCKIINSYCVFPRELKEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQEKRIVSLDSANTRLMSALTQVKERYSMQVRNGISPTNPTKLSITENGEFKNSSC

SEQ ID NO: 13486 - protein, 693 aa, Artificial Sequence
  Description of Artificial Sequence: Synthetic coding sequence
  MOD_RES (1)..(1): Any amino acid
XEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKGENSFLQATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQVINGDEIIQTGKTDRVPGFSQHQTDERADPSEGAVQHAGPQWHLPHQPHQAFHHGEW

SEQ ID NO: 13487 - protein, 1269 aa, Artificial Sequence [sequence omitted]

SEQ ID NO: 13488 - protein, 1139 aa, Artificial Sequence
  Description of Artificial Sequence: Synthetic coding sequence
MQTPEVPAERSPRRRSISGTSTSEKPNSMDTANTSPFKVPGFFSKRLKGSIKRTKSQSKLDRNTSFRLPSLRSTDDRSRGLPKLKESRSHESLLSPCSTVECLDLGRGEPVSVKPLHSSILGQDFCFEVTYLSGSKCFSCNSASERDKWMENLRRTVQPNKDNCRRAENVLRLWIIEAKDLAPKKKYFCELCLDDTLFARTTSKTKADNIFWGEHFEFFSLPPLHSITVHIYKDVEKKKKKDKNNYVGLVNIPTASVTGRQFVEKWYPVSTPTPNKGKTGGPSIRIKSRFQTITILPMEQYKEFAEFVTSNYTMLCSVLEPVISVRNKEELACALVHILQSTGRAKDFLTDLVMSEVDRCGEHDVLIFRENTIATKSIEEYLKLVGQQYLHDALGEFIKALYESDENCEVDPSKCSSSELIDHQSNLKMCCELAFCKIINSYCVFPRELKEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKGENSFLQATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQEKRIVSLDSANTRLMSALTQVKERYSMQVRNGISPTNPTKLSITENGEFKNSSC

SEQ ID NO: 13489 - protein, 1011 aa, Artificial Sequence
  Description of Artificial Sequence: Synthetic coding sequence
MDPPSPSRTSQTQPTATSPLTSYRWHTGGGGEKAAGGFRWGRFAGWGRALSHQEPMVSTQPAPRSIFRRVLSAPPKESRTSRLRLSKALWGRHKNPPPEPDPEPEQEAPELEPEPELEPPTPQIPEAPTPNVPVWDIGGFTLLDGKLVLLGGEEEGPRRPRVGSASSEGSIHVAMGNFRDPDRMPGKTEPETAGPNQVHNVRGLLKRLKEKKKARLEPRDGPPSALGSRESLATLSELDLGAERDVRIWPLHPSLLGEPHCFQVTWTGGSRCFSCRSAAERDRWIEDLRRQFQPTQDNVEREETWLSVWVHEAKGLPRAAAGAPGVRAELWLDGALLARTAPRAGPGQLFWAERFHFEALPPARRLSLRLRGLGPGSAVLGRVALALEELDAPRAPAAGLERWFPLLGAPAGAALRARIRARRLRVLPSERYKELAEFLTFHYARLCGALEPALPAQAKEELAAAMVRVLRATGRAQALVTDLGTAELARCGGREALLFRENTLATKAIDEYMKLVAQDYLQETLGQVVRRLCASTEDCEVDPSKCPASELPEHQARLRNSCEEVFETIIHSYDWFPAELGIVFSSWREACKERGSEVLGPRLVCASLFLRLLCPAILAPSLFGLAPDHPAPGPARTLTLIAKVIQNLANRAPFGEKEAYMGFMNSFLEEHGPAMQCFLDQVAMVDVDAAPSGYQGSGDLALQLAVLHAQLCTIFAELDQTTRDTLEPLPTILRAIEEGQPVLVSVPMRLPLPPAQVHSSLSAGEKPGFLAPRDLPKHTPLISKSQSLRSVRRSESWARPRPDEERPLRRPRPVQRTQSVPVRRPARRRQSAGPWPRPKGSLSMGPAPRARPWTRDSASLPRKPSVPWQRQMDQPQDRNQALGTHRPVNKLAELQCEVAALREEQKVLSRLVESLSTQIRALTEQQEQLRGQLQDLDSRLRAGSSEFDSEHNLTSNEGHSLKNLEHRLNEMERTQAQLRDAVQSLQLSPRTRGSWSQPQPLKAPCLNGDTT

SEQ ID NO: 13490 - protein, 236 aa, Artificial Sequence
  Description of Artificial Sequence: Synthetic coding sequence
MERWLFLGATEEGPKRTMDSGTRPVGSCCSSPAGLSREYKLVMLGAGGVGKSAMTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 13491 - protein, 219 aa, Artificial Sequence
  Description of Artificial Sequence: Synthetic coding sequence
MDSGTRPVGSCCSSPAGLSREYKLVMLGAGGVGKSAMTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 13492 - protein, 183 aa, Artificial Sequence
  Description of Artificial Sequence: Synthetic coding sequence
MTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 13493 - protein, 153 aa, Artificial Sequence
  Description of Artificial Sequence: Synthetic coding sequence
MEVENEASCSPGSASGGSREYKVVMLGAGGVGKSAMTMQFISHQFPDYHDPTIEDAYKTQVRIDNEPAYLDILDTAGQAEFTAMREQYMRGGEGFIICYSVTDRQSFQEAAKFKELIFQVRHTYEIPLVLVGNKIDLEQFRQPTLKEFGREEF

SEQ ID NO: 13494 - protein, 217 aa, Artificial Sequence
  Description of Artificial Sequence: Synthetic coding sequence
MEVENEASCSPGSASGGSREYKVVMLGAGGVGKSAMTMQFISHQFPDYHDPTIEDAYKTQVRIDNEPAYLDILDTAGQAEFTAMREQYMRGGEGFIICYSVTDRQSFQEAAKFKELIFQVRHTYEIPLVLVGNKIDLEQFRQVSTEEGLSLAQEYNCGFFETSAALRFCIDDAFHGLVREIRKKESMPSLMEKKLKRKDSLWKKLKGSLKKKRENMT

SEQ ID NO: 13495 - protein, 79 aa, Artificial Sequence
  Description of Artificial Sequence: Synthetic coding sequence
MPVAVGPYGQSQPSCFDRVKMGFVMGCAVGMAAGALFGTFSCLRIGMRGRELMGGIGKTMMQSGGTFGTFMAIGMGIRC

SEQ ID NO: 13496 - protein, 79 aa, Artificial Sequence; identical to SEQ ID NO: 13495
  Description of Artificial Sequence: Synthetic coding sequence

SEQ ID NO: 13497 - protein, 79 aa, Artificial Sequence; identical to SEQ ID NO: 13495
  Description of Artificial Sequence: Synthetic coding sequence

SEQ ID NO: 13498 - protein, 79 aa, Artificial Sequence; identical to SEQ ID NO: 13495
  Description of Artificial Sequence: Synthetic coding sequence

SEQ ID NO: 13499 - protein, 263 aa, Artificial Sequence
  Description of Artificial Sequence: Synthetic coding sequence
MRIFRPWRLRCPALHLPSLSVFSLRWKLPSLTTDETMCKSVTTDEWKKVFYEKMEEAKPADSWDLIIDPNLKHNVLSPGWKQYLELHASGRFHCSWCWHTWQSPYVVILFHMFLDRAQRAGSVRMRVFKQLCYECGTARLDESSMLEENIEGLVDNLITSLREQCYGERGGQYRIHVASRQDNRRHRGEFCEACQEGIVHWKPSEKLLEEEATTYTFSRAPSPTKSQDQTGSGWNFCSIPWCLFWATVLLLIIYLQFSFRSSV

SEQ ID NO: 13500 - protein, 225 aa, Artificial Sequence
  Description of Artificial Sequence: Synthetic coding sequence
MCTSLTTCEWKKVFYEKMEVAKPADSWELIIDPNLKPSELAPGWKQYLEQHASGRFHCSWCWHTWQSAHVVILFHMFLDRAQRAGSVRMRVFKQLCYECGTARLDESSMLEENIEGLVDNLITSLREQCYEEDGGQYRIHVASRPDSGPHRAEFCEACQEGIVHWKPSEKLLEEEVTTYTSEASKPRAQAGSGYNFLSLRWCLFWASLCLLVVYLQFSFLSPAFF

SEQ ID NO: 13501 - protein, 671 aa, Artificial Sequence
  Description of Artificial Sequence: Synthetic coding sequence
MQPDMSLNVIKMKSSDFLESAELDSGGFGKVSLCFHRTQGLMIMKTVYKGPNCIEHNEALLEEAKMMNRLRHSRVVKLLGVIIEEGKYSLVMEYMEKGNLMHVLKAEMSTPLSVKGRIILEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 13502 - protein, 671 aa, Artificial Sequence; identical to SEQ ID NO: 13501
  Description of Artificial Sequence: Synthetic coding sequence

SEQ ID NO: 13503 - protein, 273 aa, Artificial Sequence
  Description of Artificial Sequence: Synthetic coding sequence
MSPACRVNSKTKPTTIFMAAAWTGRRNSSPDRMWLTTERRKGDAGSPMTLLHRPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 13504 - protein, 625 aa, Artificial Sequence
  Description of Artificial Sequence: Synthetic coding sequence
MQPDMSLNVIKMKSSDFLESAELDSGGFGKVSLCFHRTQGLMIMKTVYKGPNCIEHNEALLEEAKMMNRLRHSRVVKLLGVIIEEGKYSLVMEYMEKGNLMHVLKAEIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 13505 - protein, 173 aa, Artificial Sequence
  Description of Artificial Sequence: Synthetic coding sequence
MQSELCFADIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 13506 - protein, 181 aa, Artificial Sequence
  Description of Artificial Sequence: Synthetic coding sequence
MFNRAVSRLSRKRPPSDIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 13507 - protein, 167 aa, Artificial Sequence
  Description of Artificial Sequence: Synthetic coding sequence
MEHIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 13508 - protein, 446 aa, Artificial Sequence
  Description of Artificial Sequence: Synthetic coding sequence
MERVVVSMQDPDQGVKMRSQRLLVTVIPHAVTGSDVVQWLAQKFCVSEEEALHLGAVLVQHGYIYPLRDPRSLMLRPDETPYRFQTPYFWTSTLRPAAELDYAIYLAKKNIRKRGTLVDYEKDCYDRLHKKINHAWDLVLMQAREQLRAAKQRSKGDRLVIACQEQTYWLVNRPPPGAPDVLEQGPGRGSCAASRVLMTKSADFHKREIEYFRKALGRTRVKSSVCLEAYLSFCGQRGPHDPLVSGCLPSNPWISDNDAYWVMNAPTVAAPTKLRVERWGFSFRELLEDPVGRAHFMDFLGKEFSGENLSFWEACEELRYGAQAQVPTLVDAVYEQFLAPGAAHWVNIDSRTMEQTLEGLRQPHRYVLDDAQLHIYMLMKKDSYPRFLKSDMYKALLAEAGIPLEMKRRVFPFTWRPRHSSPSPALLPTPVEPTAACGPGGGDGVA

SEQ ID NO: 13509 - protein, 261 aa, Artificial Sequence
  Description of Artificial Sequence: Synthetic coding sequence
MAAGPAPPPGRPRAQMPHLRKMERVVVSMQDPDQGVKMRSQRLLVTVIPHAVTGSDVVQWLAQKFCVSEEEALHLGAVLVQHGYIYPLRDPRSLMLRPDETPYRFQTPYFWTSTLRPAAELDYAIYLAKKNIRKRGTLVDYEKDCYDRLHKKINHAWDLVLMQAREQLRAAKQRSKGDRLVIACQEQTYWLVNRPPPGAPDVLEQGPGRGSCAASRVLMVEASRTRGTRPEGASEPRSSKTLCSNQSHPDPTSGKMHLEPH

SEQ ID NO: 13510 - protein, 467 aa, Artificial Sequence
  Description of Artificial Sequence: Synthetic coding sequence
MAAGPAPPPGRPRAQMPHLRKMERVVVSMQDPDQGVKMRSQRLLVTVIPHAVTGSDVVQWLAQKFCVSEEEALHLGAVLVQHGYIYPLRDPRSLMLRPDETPYRFQTPYFWTSTLRPAAELDYAIYLAKKNIRKRGTLVDYEKDCYDRLHKKINHAWDLVLMQAREQLRAAKQRSKGDRLVIACQEQTYWLVNRPPPGAPDVLEQGPGRGSCAASRVLMTKSADFHKREIEYFRKALGRTRVKSSVCLEAYLSFCGQRGPHDPLVSGCLPSNPWISDNDAYWVMNAPTVAAPTKLRVERWGFSFRELLEDPVGRAHFMDFLGKEFSGENLSFWEACEELRYGAQAQVPTLVDAVYEQFLAPGAAHWVNIDSRTMEQTLEGLRQPHRYVLDDAQLHIYMLMKKDSYPRFLKSDMYKALLAEAGIPLEMKRRVFPFTWRPRHSSPSPALLPTPVEPTAACGPGGGDGVA

SEQ ID NO: 13511 - protein, 134 aa, Artificial Sequence
  Description of Artificial Sequence: Synthetic coding sequence
MATSTRCATPVASCSGQTRRPTGSRSGSGVQVGAGGTPTPTHPAYQLGETGGAPSLLGLEWDSAMSPWAGGPSPPPQKSWTASTDVVRRTRLRDGASVFLGTTAGPHKGSYVQRILPSSWGSLGPGPEGGAVKA

SEQ ID NO: 13512 - protein, 159 aa, Artificial Sequence
  Description of Artificial Sequence: Synthetic coding sequence
MSRRNCWICKMCRDESKRPPSNLTLEEVLQWAQSFENLMATKYGPVVYAAYLKMEHSDENIQFWMACETYKKIASRWSRISRAKKLYKIYIQPQSPREINIDSSTRETIIRNIQEPTETCFEEAQKIVYMHMERDSYPRFLKSEMYQKLLKTMQSNNSF

SEQ ID NO: 13513 - protein, 159 aa, Artificial Sequence; identical to SEQ ID NO: 13512
  Description of Artificial Sequence: Synthetic coding sequence

SEQ ID NO: 13514 - protein, 210 aa, Artificial Sequence
  Description of Artificial Sequence: Synthetic coding sequence
MRKRQQSQNEGTPAVSQAPGNQRPNNTCCFCWCCCCSCSCLTVRNEERGENAGRPTHTTKMESIQVLEECQNPTAEEVLSWSQNFDKMMKAPAGRNLFREFLRTEYSEENLLFWLACEDLKKEQNKKVIEEKARMIYEDYISILSPKEVSLDSRVREVINRNLLDPNPHMYEDAQLQIYTLMHRDSFPRFLNSQIYKSFVESTAGSSSES

SEQ ID NO: 13515 - protein, 210 aa, Artificial Sequence; identical to SEQ ID NO: 13514
  Description of Artificial Sequence: Synthetic coding sequence

SEQ ID NO: 13516 - protein, 235 aa, Artificial Sequence
  Description of Artificial Sequence: Synthetic coding sequence
METTLLFFSQINMCESKEKTFFKLIHGSGKEETSKEAKIRAKEKRNRLSLLVQKPEFHEDTRSSRSGHLAKETRVSPEEAVKWGESFDKLLSHRDGLEAFTRFLKTEFSEENIEFWIACEDFKKSKGPQQIHLKAKAIYEKFIQTDAPKEVNLDFHTKEVITNSITQPTLHSFDAAQSRVYQLMEQDSYTRFLKSDIYLDLMEGRPQRPTNLRRRSRSFTCNEFQDVQSDVAIWL

SEQ ID NO: 13517 - protein, 217 aa, Artificial Sequence
  Description of Artificial Sequence: Synthetic coding sequence
MPTPHEAEKQITGPEEADRPPSMSSHDTASPAAPSRNPCCLCWCCCCSCSWNQERRRAWQASRESKLQPLPSCEVCATPSPEEVQSWAQSFDKLMHSPAGRSVFRAFLRTEYSEENMLFWLACEELKAEANQHVVDEKARLIYEDYVSILSPKEVSLDSRVREGINKKMQEPSAHTFDDAQLQIYTLMHRDSYPRFLSSPTYRALLLQGPSQSSSEA

SEQ ID NO: 13518 - protein, 217 aa, Artificial Sequence; identical to SEQ ID NO: 13517
  Description of Artificial Sequence: Synthetic coding sequence

SEQ ID NO: 13519 - protein, 241 aa, Artificial Sequence
  Description of Artificial Sequence: Synthetic coding sequence
MRTADGGEPAGASSPAGRVDGGLQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 13520 - protein, 388 aa, Artificial Sequence
  Description of Artificial Sequence: Synthetic coding sequence
MPQLSQDNQECLQKHFSRPSIWTQFLPLFRAQRYNTDIHQITENEGDLRAVPDIKSFPPAQLPDSPAAPKLFGLLSSPLSSLARFFSHLLRRPPPEAPRRRLDFSPLLPALPAARLSRGHEELPGRLSLLLGAALALPGRPSGGRPLRPPHPVAKPREEDATAGQSSPMPQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 13521 - protein, 1264 aa, Artificial Sequence
  Description of Artificial Sequence: Synthetic coding sequence
MPEKRLTAEPPTITEEEFEDSLATDDFLVDYFNEFLSLPTFSEAIRFNADYGVFEVANDAPQFLEKQLKKILQNQQPRNPIYDVVRKGKNEVKPVQMNAPDEDETINVNYNIMCLSREEGIKWIKKERLPAFLESDCYFEYRLAKLVSQVRWSKSGMNFTVGSNFSPWIVKKPPSLPPPATEEDNLVIMKKFYVSLGEASYTQTKDWFALAKQSQQTVSTFSLPCCVPYNKLKSPAISSVSENFIFDDGVHPRTKKDPSKTNKLISEFEEEEGEEEEVSVSLQDTPSQALLRVYLEKKQDVDESLTMHFSTCEEFLSSYIYFILRGAIQQIVGKPVGETPDYINFNNITKVSFDDCFESIHGKNFLSELVQTTKERSEEIEQTSLSSKNESAGPESRADWCISHRTYDIGNRKEFERFKKFIKGTLGERYWWLWMDIERLKVLKDPGRHQRHLEKMKKCYLVSNGDYYLSAEILSKFKLLDGSQWNEEHLRNIQSEVLKPLLLYWAPRFCVTHSASTKYASAELKFWHLRQAKPRKDIDPFPQMATLLPLRPKSCIPQIPEIQKEEFSLSQPPKSPNKSPEVKTATQKPWKRELLYPGSSKDDVIEKGSKYMSESSKVIHLTSFTDISECLKPQLDRRYAYTEEPRVKTVSDVGALGGSDMENLLQSLYVENRAGFFFTKFCEHSGNKLWKNSVYFWFDLQAYHQLFYQETLQPFKVCKQAQYLFATYVAPSATLDIGLQQEKKKEIYMKIQPPFEDLFDTAEEYILLLLLEPWTKMVKSDQIAYKKVELVEETRQLDSTYFRKLQALHKETFSKKAEDTTCEIGTGILSLSNVSKRTEYWDNVPAEYKHFKFSDLLNNKLEFEHFRQFLETHSSSMDLMCWTDIEQFRRITYRDRNQRKAKSIYIKNKYLNKKYFFGPNSPASLYQQNQVMHLSGGWGKILHEQLDAPVLVEIQKHVQNRLENVWLPLFLASEQFAARQKIKVQMKDIAEELLLQKAEKKIGVWKPVESKWISSSCKIIAFRKALLNPVTSRQFQRFVALKGDLLENGLLFWQEVQKYKDLCHSHCDESVIQKKITTIINCFINSSIPPALQIDIPVEQAQKIIEHRKELGPYVFREAQMTIFGVLFKFWPQFCEFRKNLTDENIMSVLERRQEYNKQKKKLAVLEDEKSGKDGIKQYANTSVPAIKTALLSDSFLGLQPYGRQPTWCYSKYIEALEQERILLKIQEELEKKLFAGLQPLTNFKASSSTMSLKKNMSAHSSQK

SEQ ID NO: 13522 - protein, 1251 aa, Artificial Sequence [sequence omitted]

SEQ ID NO: 13523 - protein, 198 aa, Artificial Sequence
  Description of Artificial Sequence: Synthetic coding sequence
MWNTLTRSLSDHPVGKDPQAMRTGQRQNKGMRTRLGCLSHKSDSCSDFTAILPDKPNRALKRLSTEEATRWADSFDVLLSHKYGVAAFRAFLKTEFSEENLEFWLACEEFKKTRSTAKLVSKAHRIFEEFVDVQAPREVNIDFQTREATRKNLQEPSLTCFDQAQGKVHSLMEKDSYPRFLRSKMYLDLLSQSQRRLS

SEQ ID NO: 13524 - protein, 180 aa, Artificial Sequence
  Description of Artificial Sequence: Synthetic coding sequence
MAALLMPRRNKGMRTRLGCLSHKSDSCSDFTAILPDKPNRALKRLSTEEATRWADSFDVLLSHKYGVAAFRAFLKTEFSEENLEFWLACEEFKKTRSTAKLVSKAHRIFEEFVDVQAPREVNIDFQTREATRKNLQEPSLTCFDQAQGKVHSLMEKDSYPRFLRSKMYLDLLSQSQRRLS

SEQ ID NO: 13525 - protein, 180 aa, Artificial Sequence; identical to SEQ ID NO: 13524
  Description of Artificial Sequence: Synthetic coding sequence

SEQ ID NO: 13526 - protein, 180 aa, Artificial Sequence; identical to SEQ ID NO: 13524
  Description of Artificial Sequence: Synthetic coding sequence

SEQ ID NO: 13527 - protein, 57 aa, Artificial Sequence
  Description of Artificial Sequence: Synthetic coding sequence
MAALLMPRRNKGMRTRLGCLSHKSDSCSDFTAILPDKPNRALKRLSTEEATRWADSF

SEQ ID NO: 13528 - protein, 757 aa, Artificial Sequence
  Description of Artificial Sequence: Synthetic coding sequence
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 13529 - protein, 189 aa, Artificial Sequence
  Description of Artificial Sequence: Synthetic coding sequence
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLSRAVKDGSEK

SEQ ID NO: 13530 - protein, 627 aa, Artificial Sequence
  Description of Artificial Sequence: Synthetic coding sequence
RTMVTCTQNMKAALKSLLYHSRNLGYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 13531 - protein, 652 aa, Artificial Sequence
  Description of Artificial Sequence: Synthetic coding sequence
MTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 13532 - protein, 157 aa, Artificial Sequence
  Description of Artificial Sequence: Synthetic coding sequence
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLTL

SEQ ID NO: 13533 - protein, 754 aa, Artificial Sequence
  Description of Artificial Sequence: Synthetic coding sequence
MIVFLVFKHLFSLRLITMFFLLHFIVLINVKDFALTQGSMITPSCQKGYFPCGNLTKCLPRAFHCDGKDDCGNGADEENCGDTSGWATIFGTVHGNANSVALTQECFLKQYPQCCDCKETELECVNGDLKSVPMISNNVTLLSLKKNKIHSLPDKVFIKYTKLKKIFLQHNCIRHISRKAFFGLCNLQILYLNHNCITTLRPGIFKDLHQLTWLILDDNPITRISQRLFTGLNSLFFLSMVNNYLEALPKQMCAQMPQLNWVDLEGNRIKYLTNSTFLSCDSLTVLFLPRNQIGFVPEKTFSSLKNLGELDLSSNTITELSPHLFKDLKLLQKLNLSSNPLMYLHKNQFESLKQLQSLDLERIEIPNINTRMFQPMKNLSHIYFKNFRYCSYAPHVRICMPLTDGISSFEDLLANNILRIFVWVIAFITCFGNLFVIGMRSFIKAENTTHAMSIKILCCADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLIIVFSYITMFCSIQKTALQTTEVRNCFGREVAVANRFFFIVFSDAICWIPVFVVKILSLFRVEIPDTMTSWIVIFFLPVNSALNPILYTLTTNFFKDKLKQLLHKHQRKSIFKIKKKSLSTSIVWIEDSSSLKLGVLNKITLGDSIMKPVS

SEQ ID NO: 13534 - protein, 730 aa, Artificial Sequence
  Description of Artificial Sequence: Synthetic coding sequence
MIVFLVFKHLFSLRLITMFFLLHFIVLINVKDFALTQGSMITPSCQKGYFPCGNLTKCLPRAFHCDGKDDCGNGADEENCGDTSGWATIFGTVHGNANSVALTQECFLKQYPQCCDCKETELECVNGDLKSVPMISNNVTLLSLKKNKIHSLPDKVFIKYTKLKKIFLQHNCIRHISRKAFFGLCNLQILYLNHNCITTLRPGIFKDLHQLTWLILDDNPITRISQRLFTGLNSLFFLSMVNNYLEALPKQMCAQMPQLNWVDLEGNRIKYLTNSTFLSCDSLTVLDLSSNTITELSPHLFKDLKLLQKLNLSSNPLMYLHKNQFESLKQLQSLDLERIEIPNINTRMFQPMKNLSHIYFKNFRYCSYAPHVRICMPLTDGISSFEDLLANNILRIFVWVIAFITCFGNLFVIGMRSFIKAENTTHAMSIKILCCADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLIIVFSYITMFCSIQKTALQTTEVRNCFGREVAVANRFFFIVFSDAICWIPVFVVKILSLFRVEIPDTMTSWIVIFFLPVNSALNPILYTLTTNFFKDKLKQLLHKHQRKSIFKIKKKSLSTSIVWIEDSSSLKLGVLNKITLGDSIMKPVS

SEQ ID NO: 13535 - protein, 469 aa, Artificial Sequence
  Description of Artificial Sequence: Synthetic coding sequence
MQMADAATIATMNKAAGGDKLAELFSLVPDLLEAANTSGNASLQLPDLWWELGLELPDGAPPGHPPGSGGAESADTEARVRILISVVYWVVCALGLAGNLLVLYLMKSMQGWRKSSINLFVTNLALTDFQFVLTLPFWAVENALDFKWPFGKAMCKIVSMVTSMNMYASVFFLTAMSVTRYHSVASALKSHRTRGHGRGDCCGRSLGDSCCFSAKALCVWIWALAALASLPSAIFSTTVKVMGEELCLVRFPDKLLGRDRQFWLGLYHSQKVLLGFVLPLGIIILCYLLLVRFIADRRAAGTKGGAAVAGGRPTGASARRLSKVTKSVTIVVLSFFLCWLPNQALTTWSILIKFNAVPFSQEYFLCQVYAFPVSVCLAHSNSCLNPVLYCLVRREFRKALKSLLWRIASPSITSMRPFTATTKPEHEDQGLQAPAPPHAAAEPDLLYYPPGVVVYSGGRYDLLPSSSAY

SEQ ID NO: 13536 - protein, 374 aa, Artificial Sequence
  Description of Artificial Sequence: Synthetic coding sequence
MPTLNTSASPPTFFWANASGGSVLSADDAPMPVKFLALRLMVALAYGLVGAIGLLGNLAVLWVLSNCARRAPGPPSDTFVFNLALADLGLALTLPFWAAESALDFHWPFGGALCKMVLTATVLNVYASIFLITALSVARYWVVAMAAGPGTHLSLFWARIATLAVWAAAALVTVPTAVFGVEGEVCGVRLCLLRFPSRYWLGAYQLQRVVLAFMVPLGVITTSYLLLLAFLQRRQRRRQDSRVVARSVRILVASFFLCWFPNHVVTLWGVLVKFDLVPWNSTFYTIQTYVFPVTTCLAHSNSCLNPVLYCLLRREPRQALAGTFRDLRLRLWPQGGGWVQQVALKQVGRRWVASNPRESRPSTLLTNLDRGTPG

SEQ ID NO: 13537 - protein, 271 aa, Artificial Sequence
  Description of Artificial Sequence: Synthetic coding sequence
MAPRALPGSAVLAAAVFVGGAVSSPLVAPDNGSSRTLHSRTETTPSPSNDTGNGHPEYIAYALVPVFFIMGLFGVLICHLLKKKGYRCTTEAEQDIEEEKVEKIELNDSVNENSDTVGQIVHYIMKNEANADVLKAMVADNSLYDPESPVTPSTPGSPPVSPGPLSPGGTPGKHVCGHHLHTVGGVVERDVCHRCRHKRWHFIKPTNKSRESRPRRQGEVTVLSVGRFRVTKVEHKSNQKERRSLMSVSGAETVNGEVPATPVKRERSGTE

SEQ ID NO: 13538 - protein, 271 aa, Artificial Sequence; identical to SEQ ID NO: 13537
  Description of Artificial Sequence: Synthetic coding sequence

SEQ ID NO: 13539 - protein, 120 aa, Artificial Sequence
  Description of Artificial Sequence: Synthetic coding sequence
MNATFLNHSGLEEVDGVGGGAGAALGNRTHGLGTWLGCCPGGAPLAASDGVPAGLAPDERSLWVSRVAQIAVLCVLSLTVVFGVFFLGCNLLIKSESMINFLVQERRPSKDVGAAILGLY

SEQ ID NO: 13540 - protein, 238 aa, Artificial Sequence
  Description of Artificial Sequence: Synthetic coding sequence
MGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 13541 - protein, 140 aa, Artificial Sequence
  Description of Artificial Sequence: Synthetic coding sequence
MPFCKTGNLGSILDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 13542 - protein, 449 aa, Artificial Sequence
  Description of Artificial Sequence: Synthetic coding sequence
MPATLLRAVARSHHILSKAHQCRRIGHLMLKPLKEFENTTCSTLTIRQSLDLFLPDKTASGLNKSQILEMNQKKSDTSMLSPLNAARCQDEKAHLPTMKSFGTHRRVTHKPNLLGSKWFIKILKRHFSSVSTETFVPKQDFPQVKRPLKASRTRQPSRTNLPVLSVNEDLMHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 13543 - protein, 211 aa, Artificial Sequence
  Description of Artificial Sequence: Synthetic coding sequence
MHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDREN

SEQ ID NO: 13544 - protein, 196 aa, Artificial Sequence
  Description of Artificial Sequence: Synthetic coding sequence
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 13545 - protein, 187 aa, Artificial Sequence
  Description of Artificial Sequence: Synthetic coding sequence
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWDASVCGDGRCSCKAGGGRQVPGAGCRCGANLLSPLEGMRLPRASLWLWSVLSSTLSTSRCSGRFW

SEQ ID NO: 13546 - protein, 117 aa, Artificial Sequence
  Description of Artificial Sequence: Synthetic coding sequence
MSEGDSVGESVHGKPSVVYRFFTRLGQIYQSWLDKSTPYTAVRWVVTLGLSFVYMIRVYLLQMTVLRYPPNRTRNSAPSFEGSQSLNFGMRLPRASLWLWSVLSSTLSTSRCSGRFW

SEQ ID NO: 13547 - protein, 117 aa, Artificial Sequence; identical to SEQ ID NO: 13546
  Description of Artificial Sequence: Synthetic coding sequence

SEQ ID NO: 13548 - protein, 214 aa, Artificial Sequence
  Description of Artificial Sequence: Synthetic coding sequence
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKPSPARSGTEAASRVARTVLSHC

SEQ ID NO: 13549 - protein, 158 aa, Artificial Sequence
  Description of Artificial Sequence: Synthetic coding sequence
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLF

SEQ ID NO: 13550 - protein, 369 aa, Artificial Sequence
  Description of Artificial Sequence: Synthetic coding sequence
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGESRAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 13551 - protein, 187 aa, Artificial Sequence
  Description of Artificial Sequence: Synthetic coding sequence
MAYSTVQRVALASGLVLALSLLLPKAFLSRGKRQEPPPTPEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 13552 - protein, 368 aa, Artificial Sequence
  Description of Artificial Sequence: Synthetic coding sequence
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGERAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 13553 - protein, 207 aa, Artificial Sequence
  Description of Artificial Sequence: Synthetic coding sequence
MCRLKRQEFVISRAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 13554 - protein, 128 aa, Artificial Sequence
  Description of Artificial Sequence: Synthetic coding sequence
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKVSRIILIILHQ

SEQ ID NO: 13555 - protein, 320 aa, Artificial Sequence
  Description of Artificial Sequence: Synthetic coding sequence
MMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGESRAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 13556 - protein, 329 aa, Artificial Sequence [sequence omitted]

SEQ ID NO: 13557 - protein, 288 aa, Artificial Sequence
  Description of Artificial Sequence: Synthetic coding sequence
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKISYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 13558 - protein, 537 aa, Artificial Sequence
  Description of Artificial Sequence: Synthetic coding sequence
MEPRAVAEAVETGEEDVIMEALRSYNQEHSQSFTFDDAQQEDRKRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQGWPPPQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 13559 - protein, 531 aa, Artificial Sequence
  Description of Artificial Sequence: Synthetic coding sequence
MEPRAVAEAVETGEEDVIMEALRSYNQEHSQSFTFDDAQQEDRKRLAELLVSVLEQGLPPSHRVIWLQSVRILSRDRNCLDPFTSRQSLQALACYADISVSEGSVPESADMDVVLESLKCLCNLVLSSPVAQMLAAEARLVVKLTERVGLYRERSFPHDVQFFDLRLLFLLTALRTDVRQQLFQELKGVRLLTDTLELTLGVTPEGNPPPTLLPSQETERAMEILKVLFNITLDSIKGEVDEEDAALYRHLGTLLRHCVMIATAGDRTEEFHGHAVNLLGNLPLKCLDVLLTLEPHGDSTEFMGVNMDVIRALLIFLEKRLHKTHRLKESVAPVLSVLTECARMHRPARKFLKAQVLPPLRDVRTRPEVGEMLRNKLVRLMTHLDTDVKRVAAEFLFVLCSESVPRFIKYTGYGNAAGLLAARGLMAGGRPEGQYSEDEDTDTDEYKEAKASINPVTGRVEEKPPNPMEGMTEEQKEHEAMKLVTMFDKLSRNRVIQPMGMSPRGHLTSLQDAMCETMEQQLSSDPDSDPD

SEQ ID NO: 13560 - protein, 496 aa, Artificial Sequence
  Description of Artificial Sequence: Synthetic coding sequence
MLASKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPNINLITGHLEEPMPNPIDEMTEEQKEYEAMKLVNMLDKLSRRADVKDLHQDGG

SEQ ID NO: 13561 - protein, 560 aa, Artificial Sequence
  Description of Artificial Sequence: Synthetic coding sequence
MDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPNINLITGHLEEPMPNPIDEMTEEQKEYEAMKLVNMLDKLSREELLKPMGLKPDGTITPLEEALNQYSVIEETSSDTD

SEQ ID NO: 13562 - protein, 520 aa, Artificial Sequence
  Description of Artificial Sequence: Synthetic coding sequence
MDEERALYIVRAGEAGAIERVLRDYSDKHRATFKFESTDEDKRKKLCEGIFKVLIKDIPTTCQVSCLEVLRILSRDKKVLVPVTTKENMQILLRLAKLNELDDSLEKVSEFPVIVESLKCLCNIVFNSQMAQQLSLELNLAAKLCNLLRKCKDRKFINDIKCFDLRLLFLLSLLHTDIRSQLRYELQGLPLLTQILESAFSIKWTDEYESAIDHNGPPLSPQETDCAIEALKALFNVTVDSWKVHKESDSHQFRVMAAVLRHCLLIVGPTEDKTEELHSNAVNLLSNVPVSCLDVLICPLTHEETAQEATTLDELPSNKTAEKETVLKNNTMVYNGMNMEAIHVLLNFMEKRIDKGSSYREGLTPVLSLLTECSRAHRNIRKFLKDQVLPPLRDVTNRPEVGSTVRNKLVRLMTHVDLGVKQIAAEFLFVLCKERVDSLLKYTGYGNAAGLLAARGLLAGGRGDNWYSEDEDTDTEEYKNAKPKEELLKPMGLKPDGTITPLEEALNQYSVIEETSSDTD

SEQ ID NO: 13563 - protein, 328 aa, Artificial Sequence
  Description of Artificial Sequence: Synthetic coding sequence
MMWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKDGRLSKAEILGNWNMFVGSQATNYGEDLTRHHDEL

SEQ ID NO: 13564 - protein, 441 aa, Artificial Sequence
  Description of Artificial Sequence: Synthetic coding sequence
MLRKGCCVELLLLLVAAELPLGGGCPRDCVCYPAPMTVSCQAHNFAAIPEGIPVDSERVFLQNNRIGLLQPGHFSPAMVTLWIYSNNITYIHPSTFEGFVHLEELDLGDNRQLRTLAPETFQGLVKLHALYLYKCGLSALPAGVFGGLHSLQYLYLQDNHIEYLQDDIFVDLVNLSHLFLHGNKLWSLGPGTFRGLVNLDRLLLHENQLQWVHHKAFHDLRRLTTLFLFNNSLSELQGECLAPLGALEFLRLNGNPWDCGCRARSLWEWLQRFRGSSSAVPCVSPGLRHGQDLKLLRAEDFRNCTGPASPHQIKSHTLTTTDRAARKEHHSPHGPTRSKGHPHGPRPGHRKPGKNCTNPRNRNQISKAGAGKQAPELPDYAPDYQHKFSFDIMPTARPKRKGKCARRTPIRAPSGVQQASSASSLGASLLAWTLGLAVTLR

SEQ ID NO: 13565 - protein, 420 aa, Artificial Sequence
  Description of Artificial Sequence: Synthetic coding sequence
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQDDLFADLANLSHLFLHGNRLRLLTEHVFRGLGSLDRLLLHGNRLQGVHRAAFRGLSRLTILYLFNNSLASLPGEALADLPSLEFLRLNANPWACDCRARPLWAWFQRARVSSSDVTCATPPERQGRDLRALREADFQACPPAAPTRPGSRARGNSSSNHLYGVAEAGAPPADPSTLYRDLPAEDSRGRQGGDAPTEDDYWGGYGGEDQRGEQMCPGAACQAPPDSRGPALSAGLPSPLLCLLLLVPHHL

SEQ ID NO: 13566 - protein, 337 aa, Artificial Sequence
  Description of Artificial Sequence: Synthetic coding sequence
MLRNNLGNSSDSKNEDGSVFSQTEHNIVATYLIMAGMISIISNIIVLGIFIKYKELRTPTNAIIINLAVTDIGVSSIGYPMSAASDLYGSWKFGYAGCQVYAGLNIFFGMASIGLLTVVAVDRYLTICLPDVGRRMTTNTYIGLILGAWINGLFWALMPIIGWASYAPDPTGATCTINWRKNDRSFVSYTMTVIAINFIVPLTVMFYCYYHVTLSIKHHTTSDCTESLNRDWSDQIDVTKMSVIMICMFLVAWSPYSIVCLWASFGDPKKIPPPMAIIAPLFAKSSTFYNPCIYVVANKKFRRAMLAMFKCQTHQTMPVTSILPMDVSQNPLASGRI

SEQ ID NO: 13567 - protein, 263 aa, Artificial Sequence
  Description of Artificial Sequence: Synthetic coding sequence
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTVSPVNASDIHWSSSSLPDRWIILGAFILLVLMGIVLICVWWQNGEWQAGLWPLRTS

SEQ ID NO: 13568 - protein, 227 aa, Artificial Sequence
  Description of Artificial Sequence: Synthetic coding sequence
MRRISLTSSPVRLLLFLLLLLIALEIMYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTVSPVNASDIHWSSSSLPDRWIILGAFILLVLMGIVLICVWWQNGEWQAGLWPLRTS

SEQ ID NO: 13569 - protein, 117 aa, Artificial Sequence
  Description of Artificial Sequence: Synthetic coding sequence
MRRISLTSSPVRLLLFLLLLLIALEIMVGGHSLCFNFTIKSLSRPGQPWCEAQVFLNKNLFLQYNSDNNMVKPLGLLGKKILPLCKSRCFVNVKQNGALVHPGSSPPMERNPSSLTQ

SEQ ID NO: 13570 - protein, 209 aa, Artificial Sequence
  Description of Artificial Sequence: Synthetic coding sequence
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTGN

SEQ ID NO: 13571 - protein, 80 aa, Artificial Sequence
  Description of Artificial Sequence: Synthetic coding sequence
MRRISLTSSPVRLLLFLLLLLIALEIMVGGHSLCFNFTIKSLSRPGQPWCEAQVFLNKNLFLQYNSDNNMVKPLGLLGKK

SEQ ID NO: 13572 - protein, 212 aa, Artificial Sequence
  Description of Artificial Sequence: Synthetic coding sequence
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTGRRST

SEQ ID NO: 13573 - protein, 334 aa, Artificial Sequence
  Description of Artificial Sequence: Synthetic coding sequence
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGAPPTMSSGTAQPRATATTLILCCLLIMCLLICSRHSLTQSHGHHPQSLQPPPHPPLLHPTWLLRRVLWSDSYQIAKRPLSGGHVTRVTLPIIGDDSHSLPCPLALYTINNGAARYSEPLQVSIS

SEQ ID NO: 13574 - protein, 220 aa, Artificial Sequence
  Description of Artificial Sequence: Synthetic coding sequence
MSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQG

SEQ ID NO: 13575 - protein, 260 aa, Artificial Sequence
  Description of Artificial Sequence: Synthetic coding sequence
MEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 13576 - protein, 331 aa, Artificial Sequence
  Description of Artificial Sequence: Synthetic coding sequence
MSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 13577 - protein, 336 aa, Artificial Sequence
  Description of Artificial Sequence: Synthetic coding sequence
MAVATAAAVLAALGGALWLAARRFVGPRVQRLRRGGDPGLMHGKTVLITGANSGLGRATAAELLRLGARVIMGCRDRARAEEAAGQLRRELRQAAECGPEPGVSGVGELIVRELDLASLRSVRAFCQEMLQEEPRLDVLINNAGIFQCPYMKTEDGFEMQFGVNHLGHFLLTNLLLGLLKSSAPSRIVVVSSKLYKYGDINFDDLNSEQSYNKSFCYSRSKLANILFTRELARRLEGTNVTVNVLHPGIVRTNLGRHIHIPLLVKPLFNLVSWAFFKTPVEGAQTSIYLASSPEVEGVSGRYFGDCKEEELLPKAMDESVARKLWDISEVMVGLLK

SEQ ID NO: 13578 - protein, 317 aa, Artificial Sequence
  Description of Artificial Sequence: Synthetic coding sequence
MWLYLAVFVGLYYLLHWYRERQVLSHLRDKYVFITGCDSGFGKLLARQLDARGLRVLAACLTEKGAEQLRGQTSDRLETVTLDVTKTESVAAAAQWVKECVRDKGLWGLVNNAGISLPTAPNELLTKQDFVTILDVNLLGVIDVTLSLLPLVRRARGRVVNVSSVMGRVSLFGGGYCISKYGVEAFSDSLRRELSYFGVKVAMIEPGYFKTAVTSKERFLKSFLEIWDRSSPEVKEAYGEKFVADYKKSAEQMEQKCTQDLSLVTNCMEHALIACHPRTRYSAGWDAKLLYLPMSYMPTFLVDAIMYWVSPSPAKAL

SEQ ID NO: 13579 - protein, 481 aa, Artificial Sequence
  Description of Artificial Sequence: Synthetic coding sequence
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGGECDCRIPTHQPVLSGCSPRCLLRG

SEQ ID NO: 13580 - protein, 610 aa, Artificial Sequence
  Description of Artificial Sequence: Synthetic coding sequence
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKVESVTAGSPLTNQFYLAAPRGACYGADHDLGRLHPCVMASLRAQSPIPNLYLTGQDIFTCGLVGALQGALLCSSAILKRNLYSDLKNLDSRIRAQKKKN

SEQ ID NO: 13581 - protein, 549 aa, Artificial Sequence [sequence omitted]

SEQ ID NO: 13582 - protein, 232 aa, Artificial Sequence
  Description of Artificial Sequence: Synthetic coding sequence
MKERRAPQPVVARCKLVLVGDVQCGKTAMLQVLAKDCYPETYVPTVFENYTACLETEEQRVELSLWDTSGSPYYDNVRPLCYSDSDAVLLCFDISRPETVDSALKKWRTEILDYCPSTRVLLIGCKTDLRTDLSTLMELSHQKQAPISYEQGCAIAKQLGAEIYLEGSAFTSEKSIHSIFRTASMLCLNKPSPLPQKSPVRSLSKRLLHLPSRSELISSTFKKEKAKSCSIM

SEQ ID NO: 13583 - protein, 126 aa, Artificial Sequence
  Description of Artificial Sequence: Synthetic coding sequence
WRTEILDYCPSTRVLLIGCKTDLRTDLSTLMELSHQKQAPISYEQGCAIAKQLGAEIYLEGSAFTSEKSIHSIFRTASMLCLNKPSPLPQKSPVRSLSKRLLHLPSRSELISSTFKKEKAKSCSIM

SEQ ID NO: 13584 - protein, 227 aa, Artificial Sequence
  Description of Artificial Sequence: Synthetic coding sequence
MEGQSGRCKIVVVGDAECGKTALLQVFAKDAYPGSYVPTVFENYTASFEIDKRRIELNMWDTSGSSYYDNVRPLAYPDSDAVLICFDISRPETLDSVLKKWQGETQEFCPNAKVVLVGCKLDMRTDLATLRELSKQRLIPVTHEQGTVLAKQVGAVSYVECSSRSSERSVRDVFHVATVASLGRGHRQLRRTDSRRGMQRSAQLSGRPDRGNEGEIHKDRAKSCNLM

SEQ ID NO: 13585 - protein, 228 aa, Artificial Sequence
  Description of Artificial Sequence: Synthetic coding sequence
MEGQSGRCKIVVVGDAECGKTALLQVFAKDAYPGSYVPTVFENYTASFEIDKRRIELNMWDTSGSSYYDNVRPLAYPDSDAVLICFDISRPETLDSVLKKWQGETQEFCPNAKVVLVGCKLDMRTDLATLRELSKQRLIPVTHEQVGTVLAKQVGAVSYVECSSRSSERSVRDVFHVATVASLGRGHRQLRRTDSRRGMQRSAQLSGRPDRGNEGEIHKDRAKSCNLM

SEQ ID NO: 13586 - protein, 227 aa, Artificial Sequence; identical to SEQ ID NO: 13584
  Description of Artificial Sequence: Synthetic coding sequence

SEQ ID NO: 13587 - protein, 2087 aa, Artificial Sequence
  Description of Artificial Sequence: Synthetic coding sequence
METESESSTLGDDSVFWLESEVIIQVTDCEEEEREEKFRKMKSSVHSEEDDFVPELHRNVHPRERPDWEETLSAMARGADVPEIPGDLTLKTCGSTASMKVKHVKKLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTLKDSPESVTQMLMAYLSRLSAIAGNKINCGPALTWMEIDNKGNHLLVHEESSINTPAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 13588 - protein, 322 aa, Artificial Sequence
  Description of Artificial Sequence: Synthetic coding sequence
MPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLLPHFSARTELIVPFPLRLPRKQFTPPLLGPMSPLNPLVQITVCISI

SEQ ID NO: 13589 - protein, 954 aa, Artificial Sequence
  Description of Artificial Sequence: Synthetic coding sequence
DYEETSKKEARGADVPEIPGDLTLKTCGSTASMKVKHVKKLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTLKDSPESVTQMLMAYLSRLSAIAGNKINCGPALTWMEIDNKGNHLLVHEESSINTPAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGTVCFPPFFL

SEQ ID NO: 13590 - protein, 1738 aa, Artificial Sequence
  Description of Artificial Sequence: Synthetic coding sequence
MKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 13591 - protein, 946 aa, Artificial Sequence
  Description of Artificial Sequence: Synthetic coding sequence
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 13592 - protein, 925 aa, Artificial Sequence
  Description of Artificial Sequence: Synthetic coding sequence
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 13593 - protein, 986 aa, Artificial Sequence
  Description of Artificial Sequence: Synthetic coding sequence
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKLWPPQRPVAASSCAPVCWLQAGFLVHPPWWGAMCAPSTHQRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 13594 - protein, 768 aa, Artificial Sequence
  Description of Artificial Sequence: Synthetic coding sequence
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 13595 - protein, 923 aa, Artificial Sequence [sequence omitted]

SEQ ID NO: 13596 - protein, 938 aa, Artificial Sequence
  Description of Artificial Sequence: Synthetic coding sequence
MFRRRTCGTEASLRWSHSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKAEVAGSKVVPALPESGQSEPGPPEVEGGTKATGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 13597 - protein, 1522 aa, Artificial Sequence
  Description of Artificial Sequence: Synthetic coding sequence
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKAEVAGSKVVPALPESGQSEPGPPEVEGGTKATGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 13598 - protein, 1562 aa, Artificial Sequence
  Description of Artificial Sequence: Synthetic coding sequence
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKAEVAGSKVVPALPESGQSEPGPPEVEGGTKATGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 13599 - protein, 580 aa, Artificial Sequence
  Description of Artificial Sequence: Synthetic coding sequence
MRGGHKGGRCACPRVIRKVLAKCGCCFARGGRESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 13600 - protein, 306 aa, Artificial Sequence [sequence omitted]

SEQ ID NO: 13601 - protein, 619 aa, Artificial Sequence
  Description of Artificial Sequence: Synthetic coding sequence
MKPPDRPAPGRTDRILGVMGGMLRACALPGQEGPPRRSPLGLVGTEPESERTEGDHRRDREHEVLAGALQPESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 13602 - protein, 1687 aa, Artificial Sequence
  Description of Artificial Sequence: Synthetic coding sequence
MELSCSEAPLYGQMMIYAKFDKNVYLPEDAEFYFTYDGSHQRHVMIAERIEDNVLQSSVPGHGLQETVTVSVCLCSEGYSPVTMGSGSVTYVDNMACRLARLLVTQANRLTACSHQTLLTPFALTAGALPALDEELVLALTHLELPLEWTVLGSSSLEVSSHRESLLHLAMRWGLAKLSQFFLCLPGGVQALALPNEEGATPLDLALREGHSKLVEDVTNFQGRWSPSFSRVQLSEEASLHYIHSSETLTLTLNHTAEHLLEADIKLFRKYFWDRAFLVKAFEPEARPEERTAMPSSGAETEEEIKNSVSSRSAAEKEDIKRVKSLVVQHNEHEDQHSLDLDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEALVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGSSMTKCSCTLTSPPGLWTGTTSTLKDLDTSHTESPTPHDSNSHRPQLQAFITEAKLNLPTRTMTRQDGETGDGAKENIVYL

SEQ ID NO: 13603 - protein, 1651 aa, Artificial Sequence
  Description of Artificial Sequence: Synthetic coding sequence
MELSCSEAPLYGQMMIYAKFDKNVYLPEDAEFYFTYDGSHQRHVMIAERIEDNVLQSSVPGHGLQETVTVSVCLCSEGYSPVTMGSGSVTYVDNMACRLARLLVTQANRLTACSHQTLLTPFALTAGALPALDEELVLALTHLELPLEWTVLGSSSLEVSSHRESLLHLAMRWGLAKLSQFFLCLPGGVQALALPNEEGATPLDLALREGHSKLVEDVTNFQGRWSPSFSRVQLSEEASLHYIHSSETLTLTLNHTAEHLLEADIKLFRKYFWDRAFLVKAFEPEARPEERTAMPSSGAETEEEIKNSVSSRSAAEKEDIKRVKSLVVQHNEHEDQHSLDLDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGN

SEQ ID NO: 13604 - protein, 1705 aa, Artificial Sequence
  Description of Artificial Sequence: Synthetic coding sequence
MELSCSEAPLYGQMMIYAKFDKNVYLPEDAEFYFTYDGSHQRHVMIAERIEDNVLQSSVPGHGLQETVTVSVCLCSEGYSPVTMGSGSVTYVDNMACRLARLLVTQANRLTACSHQTLLTPFALTAGALPALDEELVLALTHLELPLEWTVLGSSSLEVSSHRESLLHLAMRWGLAKLSQFFLCLPGGVQALALPNEEGATPLDLALREGHSKLVEDVTNFQGRWSPSFSRVQLSEEASLHYIHSSETLTLTLNHTAEHLLEADIKLFRKYFWDRAFLVKAFEPEARPEERTAMPSSGAETEEEIKNSVSSRSAAEKEDIKRVKSLVVQHNEHEDQHSLDLDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNDLDTSHTESPTPHDSNSHRPQLQAFITEAKLNLPTRTMTRQDGETGDGAKENIVYL

SEQ ID NO: 13605 - protein, 83 aa, Artificial Sequence
  Description of Artificial Sequence: Synthetic coding sequence
MELSCSEAPLYGQMMIYAKFDKNVYLPEDAEFYFTYDGSHQRHVMIAERIEDNVLQSSVPGHGLQETVTVSVCLCSEGYSPVT

SEQ ID NO: 13606 - protein, 1705 aa, Artificial Sequence; identical to SEQ ID NO: 13604
  Description of Artificial Sequence: Synthetic coding sequence

SEQ ID NO: 13607 - protein, 1731 aa, Artificial Sequence
  Description of Artificial Sequence: Synthetic coding sequence
MELSCSEAPLYGQMMIYAKFDKNVYLPEDAEFYFTYDGSHQRHVMIAERIEDNVLQSSVPGHGLQETVTVSVCLCSEGYSPVTMGSGSVTYVDNMACRLARLLVTQANRLTACSHQTLLTPFALTAGALPALDEELVLALTHLELPLEWTVLGSSSLEVSSHRESLLHLAMRWGLAKLSQFFLCLPGGVQALALPNEEGATPLDLALREGHSKLVEDVTNFQGRWSPSFSRVQLSEEASLHYIHSSETLTLTLNHTAEHLLEADIKLFRKYFWDRAFLVKAFEPEARPEERTAMPSSGAETEEEIKNSVSSRSAAEKEDIKRVKSLVVQHNEHEDQHSLDLDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGSSMTKCSCTLTSPPGLWTGTTSTLKDLDTSHTESPTPHDSNSHRPQLQAFITEAKLNLPTRTMTRQDGETGDGAKENIVYL

SEQ ID NO: 13608 - protein, 315 aa, Artificial Sequence
  Description of Artificial Sequence: Synthetic coding sequence
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPDFKRSCAVGFSGVLFALKVLNNHYCPGGFVNILGFPVPNRFACWVELVAIHLFSPGTSFAGHLAGILVGLMYTQGPLKKIMEACAGGFSSSVGYPGRQYYFNSSGSSGYQDYYPHGRPDHYEEAPRNYDTYTAGLSEEEQLERALQASLWDRGNTRNSPPPYGFHLSPEEMRRQRLHRFDSQ

SEQ ID NO: 13609 - protein, 315 aa, Artificial Sequence; identical to SEQ ID NO: 13608
  Description of Artificial Sequence: Synthetic coding sequence

SEQ ID NO: 13610 - protein, 151 aa, Artificial Sequence
  Description of Artificial Sequence: Synthetic coding sequence
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPDFKRSCAVGFSGVLFALK

SEQ ID NO: 13611 - protein, 134 aa, Artificial Sequence
  Description of Artificial Sequence: Synthetic coding sequence
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPD

SEQ ID NO: 13612 - protein, 54 aa, Artificial Sequence
  Description of Artificial Sequence: Synthetic coding sequence
MQRRSRGINTGLILLLSQIFHVGINNIPPVTLATLALNIWFFLNPQKPLYSSCL

SEQ ID NO: 13613 - protein, 50 aa, Artificial Sequence
  Description of Artificial Sequence: Synthetic coding sequence
MQRRSRGINTGLILLLSQIFHVGINNIPPVTLATLALNIWFFLNPQKPLY

SEQ ID NO: 13614 - protein, 6 aa, Artificial Sequence
  Description of Artificial Sequence: Synthetic coding sequence
MQRRSR

SEQ ID NO: 13615 - protein, 124 aa, Artificial Sequence
  Description of Artificial Sequence: Synthetic coding sequence
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQF

SEQ ID NO: 13616 - protein, 364 aa, Artificial Sequence
  Description of Artificial Sequence: Synthetic coding sequence
MAASGPGCRSWCLCPEVPSATFFTALLSLLVSGPRLFLLQQPLAPSGLTLKSEALRNWQVYRLVTYIFVYENPISLLCGAIIIWRFAGNFERTVGTVRHCFFTVIFAIFSAIIFLSFEAVSSLSKLGEVEDARGFTPVAFAMLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRKLNPVPGSYPTQSCHPHLSPSHPVSQTQHASGQKLASWPSCTPGHMPTLPPYQPASGLCYVQNHFGPNPTSSSVYPASAGTSLGIQPPTPVNSPGTVYSGALGTPGAAGSKESSRVPMP

SEQ ID NO: 13617 - protein, 223 aa, Artificial Sequence
  Description of Artificial Sequence: Synthetic coding sequence
MLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRKLNPVPGSYPTQSCHPHLSPSHPVSQTQHASGQKLASWPSCTPGHMPTLPPYQPASGLCYVQNHFGPNPTSSSVYPASAGTSLGIQPPTPVNSPGTVYSGALGTPGAAGSKESSRVPMP

SEQ ID NO: 13618 - protein, 434 aa, Artificial Sequence
  Description of Artificial Sequence: Synthetic coding sequence
MGRGLWEAWPPAGSSAVAKGNCREEAEGAEDRQPASRRGAGTTAAMAASGPGCRSWCLCPEVPSATFFTALLSLLVSGPRLFLLQQPLAPSGLTLKSEALRNWQVYRLVTYIFVYENPISLLCGAIIIWRFAGNFERTVGTVRHCFFTVIFAIFSAIIFLSFEAVSSLSKLGEVEDARGFTPVAFAMLGVTTVRSRMRRALVFGMVVPSVLVPWLLLGASWLIPQTSFLSNVCGLSIGLAYPHLLLFHRPLRASGTEARSDLPLQPDEEDIRVQVRLRVFSREEGSPEPETEPGAWLLPHTELPPSPVPKPPCVPDAARQWSEAGLLASCTPGHMPTLPPYQPASGLCYVQNHFGPNPTSSSVYPASAGTSLGIQPPTPVNSPGTVYSGALGHQGLQAPRSPPGSPCPERISREVISLGLLKVLPKSLLTKVTY

SEQ ID NO: 13619 - protein, 223 aa, Artificial Sequence; identical to SEQ ID NO: 13617
  Description of Artificial Sequence: Synthetic coding sequence

SEQ ID NO: 13620 - protein, 386 aa, Artificial Sequence
  Description of Artificial Sequence: Synthetic coding sequence
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQVLQEGVLCRTLAGCWPLRLLATPGSLAELPVTHPAGVRPPIPGPPYVASPDLWSHWEDSALPPPSLRPVQPTWEGSSEAGLDWAGASFSPGTPMWAALDEQMLQEGIQASLLDGPAQEPQSAPWLSKSSVSSLRLQQLERMGFPTEQAVVALAATGRVEGAVSLLVGGQVGTETLVTHGKGGPAHSEGPGPP

SEQ ID NO: 13621 - protein, 136 aa, Artificial Sequence
  Description of Artificial Sequence: Synthetic coding sequence
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRP

SEQ ID NO: 13622 - protein, 195 aa, Artificial Sequence
  Description of Artificial Sequence: Synthetic coding sequence
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQV

SEQ ID NO: 13623 - protein, 438 aa, Artificial Sequence
  Description of Artificial Sequence: Synthetic coding sequence
MGRVEDGGTTEELEDWDPGTSALPAPGIKQGPREQTGTGPLSQKCWEPEPDAPSQPGPALWSRGRARTQALAGGSSLQQLDPENTGFIGADTFTGLVHSHELPLDPAKLDMLVALAQSNEQGQVCYQELVDLISSKRSSSFKRAIANGQRALPRDGPLDEPGLGVYKRFVRYVAYEILPCEVDRRWYFYRHRSCPPPVFMASVTLAQIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMNWAGMRCPYKLLRMVLALVCMSSEVGRAVWLRFSPPLPASGPQPSFMAHLAGAVVGVSMGLTILRSYEERLRDQCGWWVVLLAYGTFLLFAVFWNVFAYDLLGAHIPPPP

SEQ ID NO: 13624 - protein, 373 aa, Artificial Sequence
  Description of Artificial Sequence: Synthetic coding sequence
MDRSSLLQLIQEQQLDPENTGFIGADTFTGLVHSHELPLDPAKLDMLVALAQSNEQGQVCYQELVDLISSKRSSSFKRAIANGQRALPRDGPLDEPGLGVYKRFVRYVAYEILPCEVDRRWYFYRHRSCPPPVFMASVTLAQIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMNWAGMRCPYKLLRMVLALVCMSSEVGRAVWLRFSPPLPASGPQPSFMAHLAGAVVGVSMGLTILRSYEERLRDQCGWWVVLLAYGTFLLFAVFWNVFAYDLLGAHIPPPP

SEQ ID NO: 13625 - protein, 310 aa, Artificial Sequence
  Description of Artificial Sequence: Synthetic coding sequence
MDRSSLLQLIQEQQLDPENTGFIGADTFTGLVHSHELPLDPAKLDMLVALAQSNEQGQVCYQELVDLISSKRSSSFKRAIANGQRALPRDGPLDEPGLGVYKRFVRYVAYEILPCEVDRRWYFYRHRSCPPPVFMASVTLAQIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMVTGLPGGGRGEGPQVSLTTSRLHTPIELGWDEMSLQVAEDGAGLGVQ

SEQ ID NO: 13626 - protein, 303 aa, Artificial Sequence
  Description of Artificial Sequence: Synthetic coding sequence
MAAVHDLEMESMNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAGVQHILGNLCMQLVLGIPLEMVHKGLRVGLVYLAGVIAGSLASSIFDPLRYLVGASGGVYALMGGYFMNVLVNFQEMIPAFGIFRLLIIILIIVLDMGFALYRRFFVPEDGSPVSFAAHIAGGFAGMSIGYTVFSCFDKALLKDPRFWIAIAAYLACVLFAVFFNIFLSPAN

SEQ ID NO: 13627 - protein, 383 aa, Artificial Sequence
  Description of Artificial Sequence: Synthetic coding sequence
MQLGKRHKLTTKSVCHGKGVVIRVLALPGPSWVRRRREGKALESSRCARQPREERQPEDLGPPAVPWDSCPSGEEGGPRTMAAVHDLEMESMNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAGVQHILGNLCMQLVLGIPLEMVHKGLRVGLVYLAGVIAGSLASSIFDPLRYLVGASGGVYALMGGYFMNVLVNFQEMIPAFGIFRLLIIILIIVLDMGFALYRRFFVPEDGSPVSFAAHIAGGFAGMSIGYTVFSCFDKALLKDPRFWIAIAAYLACVLFAVFFNIFLSPAN

SEQ ID NO: 13628 - protein, 303 aa, Artificial Sequence; identical to SEQ ID NO: 13626
  Description of Artificial Sequence: Synthetic coding sequence

SEQ ID NO: 13629 - protein, 370 aa, Artificial Sequence
  Description of Artificial Sequence: Synthetic coding sequence
MTTTYMLSKNPLEVFDICRFNTCNFGKALESSRCARQPREERQPEDLGPPAVPWDSCPSGEEGGPRTMAAVHDLEMESMNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAGVQHILGNLCMQLVLGIPLEMVHKGLRVGLVYLAGVIAGSLASSIFDPLRYLVGASGGVYALMGGYFMNVLVNFQEMIPAFGIFRLLIIILIIVLDMGFALYRRFFVPEDGSPVSFAAHIAGGFAGMSIGYTVFSCFDKALLKDPRFWIAIAAYLACVLFAVFFNIFLSPAN

SEQ ID NO: 13630 - protein, 404 aa, Artificial Sequence
  Description of Artificial Sequence: Synthetic coding sequence
MGEHPSPGPAVAACAEAERIEELEPEAEERLPAAPEDHWKVLFDQFDPGNTGYISTGKFRSLLESHSSKLDPHKREVLLALADSHADGQIGYQDFVSLMSNKRSNSFRQAILQGNRRLSSKALLEEKGLSLSQRLIRHVAYETLPREIDRKWYYDSYTCCPPPWFMITVTLLEVAFFLYNGVSLGQFVLQVTHPRYLKNSLVYHPQLRAQVWRYLTYIFMHAGIEHLGLNVVLQLLVGVPLEMVHGATRIGLVYVAGVVAGSLAVSVADMTAPVVGSSGGVYALVSAHLANIVMNWSGMKCQFKLLRMAVALICMSMEFGRAVWLRFHPSAYPPCPHPSFVAHLGGVAVGITLGVVVLRNYEQRLQDQSLWWIFVAMYTVFVLFAVFWNIFAYTLLDLKLPPPP

SEQ ID NO: 13631 - protein, 428 aa, Artificial Sequence
  Description of Artificial Sequence: Synthetic coding sequence
MGEHPSPGPAVAACAEAERIEELEPEAEERLPAAPEDHWKVLFDQFDPGNTGYISTGKFRSLLESHSSKLDPHKREVLLALADSHADGQIGYQDFVSLMSNKRSNSFRQAILQGNRRLSSKALLEEKGLSLSQRLIRHVAYETLPREIDRKWYYDSYTCCPPPWFMITVTLLEVAFFLYNGVSLGQFVLQVTHPRYLKNSLVYHPQLRAQVWRYLTYIFMHAGIEHLGLNVVLQLLVGVPLEMVHGATRIGLVYVAGVVAELVRHEVPVQAAADGCGPYLYEHGVWAGRVAPLPPVGLSPVPSPKLCGALGWRGRGHHPGRGGPEELRAEAPGPVTVVDFCGHVHRLRAVRCLLEHLCLHPAGLKAAASPLRAGGPRSGRGGKSSTHRERLRGFFSSPAQLGRADKDRRLWATVMFVFRFGHTVETLF

SEQ ID NO: 13632 - protein, 306 aa, Artificial Sequence
  Description of Artificial Sequence: Synthetic coding sequence
MSNKRSNSFRQAILQGNRRLSSKALLEEKGLSLSQRLIRHVAYETLPREIDRKWYYDSYTCCPPPWFMITVTLLEVAFFLYNGVSLGQFVLQVTHPRYLKNSLVYHPQLRAQVWRYLTYIFMHAGIEHLGLNVVLQLLVGVPLEMVHGATRIGLVYVAGVVAGSLAVSVADMTAPVVGSSGGVYALVSAHLANIVMNWSGMKCQFKLLRMAVALICMSMEFGRAVWLRFHPSAYPPCPHPSFVAHLGGVAVGITLGVVVLRNYEQRLQDQSLWWIFVAMYTVFVLFAVFWNIFAYTLLDLKLPPPP

SEQ ID NO: 13633 - protein, 396 aa, Artificial Sequence
  Description of Artificial Sequence: Synthetic coding sequence
MGEHPSPGPAVAACAEAERIEELEPEAEERLPAAPEDFDPGNTGYISTGKFRSLLESHSSKLDPHKREVLLALADSHADGQIGYQDFVSLMSNKRSNSFRQAILQGNRRLSSKALLEEKGLSLSQRLIRHVAYETLPREIDRKWYYDSYTCCPPPWFMITVTLLEVAFFLYNGVSLGQFVLQVTHPRYLKNSLVYHPQLRAQVWRYLTYIFMHAGIEHLGLNVVLQLLVGVPLEMVHGATRIGLVYVAGVVAGSLAVSVADMTAPVVGSSGGVYALVSAHLANIVMNWSGMKCQFKLLRMAVALICMSMEFGRAVWLRFHPSAYPPCPHPSFVAHLGGVAVGITLGVVVLRNYEQRLQDQSLWWIFVAMYTVFVLFAVFWNIFAYTLLDLKLPPPP

SEQ ID NO: 13634 - protein, 308 aa, Artificial Sequence
  Description of Artificial Sequence: Synthetic coding sequence
MCLLLSSAVFGVKYNLLAHTTLTLESAEDSFKTHNLSINGNEESSFWLPLYGNMCCRLVAQPACMAEDAFAGFLNQQQMVEGLISWRRLYCVLRGGKLYCFYSPEEIEAKVEPALVVPINKSLVLFEDSLEGIQLAISQSFKETRIRAMDKDAKKRIHNFSVINPVPGQAITQIFAVDNREDLQKWMEAFWQHFFDLSQWKHCCEELMKIEIMSPRKPPLFLTKEATSVYHDMSIDSPMKLESLTDIIQKKIEETNGQFLIGQHEESLPPPWATLFDGNHQMVIQKKNNSNQLHNLQKLPATSKFLFT

SEQ ID NO: 13635 - protein, 609 aa, Artificial Sequence
  Description of Artificial Sequence: Synthetic coding sequence
MEGPSLRGPALRLAGLPTQQDCNIQEKIDLEIRMREGIWKLLSLSTQKDQVLHAVKNLMVCNARLMAYTSELQKLEEQIANQTGRCDVKFESKERTACKGKIAISDIRIPLMWKDSDHFSNKERSRRYAIFCLFKMGANVFDTDVVNVDKTITDICFENVTIFNEAGPDFQIKVEVYSCCTEESSITNTPKKLAKKLKTSISKATGKKISSVLQEEDDEMCLLLSSAVFGVKYNLLAHTTLTLESAEDSFKTHNLSINGNEESSFWLPLYGNMCCRLVAQPACMAEDAFAGFLNQQQMVEGLISWRRLYCVLRGGKLYCFYSPEEIEAKVEPALVVPINKETRIRAMDKDAKKRIHNFSVINPVPGQAITQIFAVDNREDLQKWMEAFWQHFFDLSQWKHCCEELMKIEIMSPRKPPLFLTKEATSVYHDMSIDSPMKLESLTDIIQKKIEETNGQFLIGQHEESLPPPWATLFDGNHQMVIQKKVLYPASEPLHDEKGKKRQAPLPPSDKLPFSLKSQSNTDQLVKDNWGKTSVSQTSSLDTKLSTLMHHLQKPMAAPRKLLPARRNRLSDGEHTDTKTNFEAKPVPAPRQKSIKDILDPRSWLQAQV

SEQ ID NO: 13636 - protein, 163 aa, Artificial Sequence
  Description of Artificial Sequence: Synthetic coding sequence
MEGPSLRGPALRLAGLPTQQDCNIQEKIDLEIRMREGIWKLLSLSTQKDQVLHAVKNLMVCNARLMAYTSELQKLEEQIANQTGRCDVKFESKERTACKGKIAISDIRIPLMWKDSDHFSNKERSRRYAIFCLFKMGANVFDTDVVNVDKTITDICFENVTIL

SEQ ID NO: 13637 - protein, 527 aa, Artificial Sequence
  Description of Artificial Sequence: Synthetic coding sequence
MEGPSLRGPALRLAGLPTQQDCNIQEKIDLEIRMREGIWKLLSLSTQKDQVLHAVKNLMVCNARLMAYTSELQKLEEQIANQTGRCDVKFESKERTACKGKIAISDIRIPLMWKDSDHFSNKERSRRYAIFCLFKMGANVFDTDVVNVDKTITDICFENVTIFNEAGPDFQIKVEVYSCCTEESSITNTPKKLAKKLKTSISKATGKKISSVLQEEDDEMCLLLSSAVFGVKYNLLAHTTLTLESAEDSFKTHNLSINGNEESSFWLPLYGNMCCRLVAQPACMAEDAFAGFLNQQQMVEGLISWRRLYCVLRGGKLYCFYSPEEIEAKVEPALVVPINKSLVLFEDSLEGIQLAISQSFKETRIRAMDKDAKKRIHNFSVINPVPGQAITQIFAVDNREDLQKWMEAFWQHFFDLSQWKHCCEELMKIEIMSPRKPPLFLTKEATSVYHDMSIDSPMKLESLTDIIQKKIEETNGQFLIGQHEESLPPPWATLFDGNHQMVIQKKNNSNQLHNLQKLPATSKFLFT

SEQ ID NO: 13638 - protein, 98 aa, Artificial Sequence
  Description of Artificial Sequence: Synthetic coding sequence
MASLLCCGPKLAACGIVLSAWGVIMLIMLGIFFNVHSAVLIEDVPFTEKDFENGPQNIYNLYEQVSYNCFIAAGLYLLLGGFSFCQVRLNKRKEYMVR

SEQ ID NO: 13639 - protein, 137 aa, Artificial Sequence
  Description of Artificial Sequence: Synthetic coding sequence
MGWLRPGPRPLCPPARASWAFSHRFPSPLAPRRSPTPFFMASLLCCGPKLAACGIVLSAWGVIMLIMLGIFFNVHSAVLIEDVPFTEKDFENGPQNIYNLYEQVSYNCFIAAGLYLLLGGFSFCQVRLNKRKEYMVR

SEQ ID NO: 13640 - protein, 156 aa, Artificial Sequence
  Description of Artificial Sequence: Synthetic coding sequence
MQIFVKTLTGKTITLEVEPSDTIENVKAKIQDKEGIPPDQQRLIFAGKQLEDGRTLSDYNIQKESTLHLVLRLRGGAKKRKKKSYTTPKKNKHKRKKVKLAVLKYYKVDENGKISRLRRECPSDECGAGVFMASHFDRHYCGKCCLTYCFNKPEDK

SEQ ID NO: 13641 - protein, 156 aa, Artificial Sequence; identical to SEQ ID NO: 13640
  Description of Artificial Sequence: Synthetic coding sequence

SEQ ID NO: 13642 - protein, 156 aa, Artificial Sequence; identical to SEQ ID NO: 13640
  Description of Artificial Sequence: Synthetic coding sequence

SEQ ID NO: 13643 - protein, 106 aa, Artificial Sequence
  Description of Artificial Sequence: Synthetic coding sequence
MQIFVKTLTGKTITLEVEPSDTIENVKAKIQDKEGIPPDQQRLIFAGKQLEDGRTLSDYNIQKESTLHLVLRLRGGAKKRKKKSYTTPKKNKHKRKKVKLAVLKYY

SEQ ID NO: 13644 - protein, 475 aa, Artificial Sequence
  Description of Artificial Sequence: Synthetic coding sequence
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHVAQENRVVAFFSLALLLAPLVETLILLDRLLYLQEQGFHAELLPIFSPELSPRNLVLVATKMPLGQALSVLETEDS

SEQ ID NO: 13645 - protein, 277 aa, Artificial Sequence
  Description of Artificial Sequence: Synthetic coding sequence
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQICAAGATASGARSPAATESGCPSGPRGPGEPCGGLLQPGSTACPTGGDAYSTGPAAVPSGTGFPC

SEQ ID NO: 13646 - protein, 1197 aa, Artificial Sequence
  Description of Artificial Sequence: Synthetic coding sequence
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 13647 - protein, 1297 aa, Artificial Sequence
  Description of Artificial Sequence: Synthetic coding sequence
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 13648 - protein, 1236 aa, Artificial Sequence
  Description of Artificial Sequence: Synthetic coding sequence
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 13649 - protein, 1015 aa, Artificial Sequence
  Description of Artificial Sequence: Synthetic coding sequence
MDIMSAQASSGSTSVLRWVLSCLATLLRKQDLEAWGYPVTLQVYHGLLSFTVHPKPKLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 13650 - protein, 282 aa, Artificial Sequence
  Description of Artificial Sequence: Synthetic coding sequence
MAAAAPDSRVSEEENLKKTPKKKMKMVTGAVASVLEDEATDTSDSEGSCGSEKDHFYSDDDAIEADSEGDAEPCDKENENDGESSVGTNMGWADAMAKVLNKKTPESKPTILVKNKKLEKEKEKLKQERLEKIKQRDKRLEWEMMCRVKPDVVQDKETERNLQRIATRGVVQLFNAVQKHQKNVDEKVKEAGSSMRKRAKLISTVSKKDFISVLRGMDGSTNETASSRKKPKAKQTEVKSEEGPGWTILRDDFMMGASMKDWDKESDGPDDSRPESASDSDT

SEQ ID NO: 13651 - protein, 242 aa, Artificial Sequence
  Description of Artificial Sequence: Synthetic coding sequence
MWAAAGGLWRSRAGLRALFRSRDAALFPGCERGLHCSAVSCKNWLKKFASKTKKKVWYESPSLGSHSTYKPSKLEFLMRSTSKKTRKEDHARLRALNGLLYKALTDLLCTPEVSQELYDLNVELSKVSLTPDFSACRAYWKTTLSAEQNAHMEAVLQRSAAHMSLISYWQSQTLDPGMKETTLYKMISGTLMPHNPAAPQSRPQAPVCVGSIMRRSTSRLWSTKGGKIKGSGAWCGRGRWLS

SEQ ID NO: 13652 - protein, 343 aa, Artificial Sequence
  Description of Artificial Sequence: Synthetic coding sequence
MWAAAGGLWRSRAGLRALFRSRDAALFPGCERGLHCSAVSCKNWLKKFASKTKKKVWYESPSLGSHSTYKPSKLEFLMRSTSKKTRKEDHARLRALNGLLYKALTDLLCTPEVSQELYDLNVELSKVSLTPDFSACRAYWKTTLSAEQNAHMEAVLQRSAAHMRHLLMSQQTLRNVPPIVFVQDKGNAALAELDQLLAVADFGPRDERDNFVQNDFRDPDAPQPCGTTEPTTSSSLCGIDHEALNKQIMEYKRRKDKGLGGLVWQGQVAELTTQMKKGRKRAKPRLEQDSSLKSYLSGEEVEDDLDLVGAPEYECYAPDTEELEAERGGGRTEDGHSCGASRE

SEQ ID NO: 13653 - protein, 685 aa, Artificial Sequence
  Description of Artificial Sequence: Synthetic coding sequence
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVIANDRSPLVGKIHWEKMVKKVSRFGIRTGTFNCSSDPRYCRRRGWVRSTLIMSVPQTSTSKGKVMLKEYSGRKIEVEHIFKWITAHAASRIKTIYNAEHLKEEWNKSDQYWLKIYLFANLDQPPAFFSALSIKFTGRVEFIFVNVENWDNKSYMTDIGIYNMPSYILRTPEGIYRYGNHTGEFISLQAMDSFLRSLQPEVNDLFVLSLVLVNLMAWMDLFITQGATIKRFVVLISTLGTYNSLLIISWLPVLGFLQLPYLDSFYEYSLKLLRYSNTTTLASWVRADWMFYSSHPALFLSTYLGHGLLIDYFEKKRRRNNNNDEVNANNLEWLSSLWDWYTSYLFHPIASFQNFPVESDWDEDPDLFLERLAFPDLWLHPLIPTDYIKNLPMWRFKCLGVQSEEEMSEGSQDTENDSESENTDTLSSEKEVFEDKQSVLHNSPGTASHCDAEACSCANKYCQTSPCERKGRSYGSYNTNEDMEPDWLTWPADMLHCTECVVCLENFENGCLLMGLPCGHVFHQNCIVMWLAGGRHCCPVCRWPSYKKKQPYAQHQPLSNDVPS

SEQ ID NO: 13654 - protein, 327 aa, Artificial Sequence
  Description of Artificial Sequence: Synthetic coding sequence
MAAVVEVEVGGGAAGERELDEVDMSDLSPEEQWRVEHARMHAKHRGHEAMHAEMVLILIATLVVAQLLLVQWKQRHPRSYNMVTLFQMWVVPLYFTVKLHWWRFLVIWILFSAVTAFVTFRATRKPLVQTTPRLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 13655 - protein, 246 aa, Artificial Sequence
  Description of Artificial Sequence: Synthetic coding sequence
MVTLFQMWVVPLYFTVKLHWWRFLVIWILFSAVTAFVTFRATRKPLVQTTPRLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 13656 - protein, 155 aa, Artificial Sequence
  Description of Artificial Sequence: Synthetic coding sequence
MHPFQWCNGCFCGLGLVSTNKSCSMPPISFQDLPLNIYMVIFGTGIFVFMLSLIFCCYFISKLRNQAQSERYGYKEVVLKGDAKKLQLYGQTCAVCLEDFKGKDELGVLPCQHAFHRKCLVKWLEVRCVCPMCNKPIASPSEATQNIGILLDELV

SEQ ID NO: 13657 - protein, 381 aa, Artificial Sequence
  Description of Artificial Sequence: Synthetic coding sequence
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 13658 - protein, 381 aa, Artificial Sequence; identical to SEQ ID NO: 13657
  Description of Artificial Sequence: Synthetic coding sequence

SEQ ID NO: 13659 - protein, 165 aa, Artificial Sequence
  Description of Artificial Sequence: Synthetic coding sequence
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYE

SEQ ID NO: 13660 - protein, 72 aa, Artificial Sequence
  Description of Artificial Sequence: Synthetic coding sequence
MLLSIGMLMLSATQVYTILTVQLFAFLNLLPVEADILAYNFENASQTFDDLPARFGYRLPAEGLKGFLINSK

SEQ ID NO: 13661 - protein, 163 aa, Artificial Sequence
  Description of Artificial Sequence: Synthetic coding sequence
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFT

SEQ ID NO: 13662 - protein, 115 aa, Artificial Sequence
  Description of Artificial Sequence: Synthetic coding sequence
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAG

SEQ ID NO: 13663 - protein, 80 aa, Artificial Sequence
  Description of Artificial Sequence: Synthetic coding sequence
MLLSIGMLMLSATQVYTILTVQLFAFLNLLPVEADILAYNFENASQTFDDLPARFGYRLPAEGLKGFLINSKPENACEPI

SEQ ID NO: 13664 - protein, 90 aa, Artificial Sequence
  Description of Artificial Sequence: Synthetic coding sequence
MLLSIGMLMLSATQVYTILTVQLFAFLNLLPVEADILAYNFENASQTFDDLPARFGYRLPAEGLKGFLINSKPENACEPIVPPPVKDNSS

SEQ ID NO: 13665 - protein, 291 aa, Artificial Sequence
  Description of Artificial Sequence: Synthetic coding sequence
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKPKHKKKK

SEQ ID NO: 13666 - protein, 419 aa, Artificial Sequence
  Description of Artificial Sequence: Synthetic coding sequence
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 13667 - protein, 376 aa, Artificial Sequence
  Description of Artificial Sequence: Synthetic coding sequence
MHLLKVGTWRNNTASSWLMKFSVLWLVSQNCCRASVVWMAYMNISFHVGNHVLSELGETGVFGRSSTLKRVAGVIVPPEGKIQNACNPNTIFSRSKYSETWLALIERGGCTFTQKIKVATEKGASGVIIYNVPGTGNQVFPMFHQAFEDVVVVMIGNLKGTEIFHLIKKGVLITAVVEVGRKHIIWMNHYLVSFVIVTTATLAYFIFYHIHRLCLARIQNRRWQRLTTDLQNTFGQLQLRVVKEGDEEINPNGDSCVICFERYKPNDIVRILTCKHFFHKNCIDPWILPHGTCPICKCDILKVLGIQVVVENGTEPLQVLMSNELPETLSPSEEETNNEVSPAGTSDKVIHVEENPTSQNNDIQPHSVVEDVHPSP

SEQ ID NO: 13668 - protein, 292 aa, Artificial Sequence
  Description of Artificial Sequence: Synthetic coding sequence
MTTTRYRPTWDLALDPLVSCKLCLGEYPVEQMTTIAQCQCIFCTLCLKQYVELLIKEGLETAISCPDAACPKQGHLQENEIECMVAAEIMQRYKKLQFEREVLFDPCRTWCPASTCQAVCQLQDVGLQTPQPVQCKACRMEFCSTCKASWHPGQGCPETMPITFLPGETSAAFKMEEDDAPIKRCPKCKVYIERDEGCAQMMCKNCKHAFCWYCLESLDDDFLLIHYDKGPCRNKLGHSRASVIWHRTQVVGIFAGFGLLLLVASPFLLLATPFVLCCKCKCSKGDDDPLPT

SEQ ID NO: 13669 - protein, 55 aa, Artificial Sequence
  Description of Artificial Sequence: Synthetic coding sequence
MTTTRYRPTWDLALDPLVSCKLCLGEYPVEQMTTIAQCQCIFCTLCLKQYVELLI

SEQ ID NO: 13670 - protein, 198 aa, Artificial Sequence
  Description of Artificial Sequence: Synthetic coding sequence
MTTTRYRPTWDLALDPLVSCKLCLGEYPVEQMTTIAQCQCIFCTLCLKQYVELLIKEGLETAISCPDAACPKQGHLQENEIECMVAAEIMQRYKKLQFEREVLFDPCRTWCPASTCQAVCQLQDVGLQTPQPVQCKACRMEFCSTCKASWHPGQGCPETMPITFLPGETSAAFKMEEDDAPIKRCPKCSKGDDDPLPT

SEQ ID NO: 13671 - protein, 55 aa, Artificial Sequence; identical to SEQ ID NO: 13669
  Description of Artificial Sequence: Synthetic coding sequence

SEQ ID NO: 13672 - protein, 303 aa, Artificial Sequence
  Description of Artificial Sequence: Synthetic coding sequence
MGSAGRLHYLAMTAENPTPGDLAPAPLITCKLCLCEQSLDKMTTLQECQCIFCTACLKQYMQLAIREGCGSPITCPDMVCLNHGTLQEAEIACLVPVDQFQLYQRLKFEREVHLDPYRTWCPVADCQTVCPVASSDPGQPVLVECPSCHLKFCSCCKDAWHAEVSCRDSQPIVLPTEHRALFGTDAEAPIKQCPVCRVYIERNEGCAQMMCKNCKHTFCWYCLQNLDNDIFLRHYDKGPCRNKLGHSRASVMWNRTQVVGILVGLGIIALVTSPLLLLASPCIICCVCKSCRGKKKKHDPSTT

SEQ ID NO: 13673 - protein, 214 aa, Artificial Sequence
  Description of Artificial Sequence: Synthetic coding sequence
MLWITMPHPAHLGLFIAVTLSEVHLDPYRTWCPVADCQTVCPVASSDPGQPVLVECPSCHLKFCSCCKDAWHAEVSCRDSQPIVLPTEHRALFGTDAEAPIKQCPVCRVYIERNEGCAQMMCKNCKHTFCWYCLQNLDNDIFLRHYDKGPCRNKLGHSRASVMWNRTQVVGILVGLGIIALVTSPLLLLASPCIICCVCKSCRGKKKKHDPSTT

SEQ ID NO: 13674 - protein, 691 aa, Artificial Sequence
  Description of Artificial Sequence: Synthetic coding sequence
MMRNHRIASSLCGDQVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 13675 - protein, 680 aa, Artificial Sequence
  Description of Artificial Sequence: Synthetic coding sequence
MAEVVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 13676 - protein, 663 aa, Artificial Sequence
  Description of Artificial Sequence: Synthetic coding sequence
MAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 13677 - protein, 693 aa, Artificial Sequence
  Description of Artificial Sequence: Synthetic coding sequence
MHRDRISPSNSPTWSLQVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 13678 - protein, 663 aa, Artificial Sequence; identical to SEQ ID NO: 13676
  Description of Artificial Sequence: Synthetic coding sequence

SEQ ID NO: 13679 - protein, 677 aa, Artificial Sequence
  Description of Artificial Sequence: Synthetic coding sequence
MVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 13680 - protein, 679 aa, Artificial Sequence
  Description of Artificial Sequence: Synthetic coding sequence
MAEVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 13681 - protein, 663 aa, Artificial Sequence; identical to SEQ ID NO: 13676
  Description of Artificial Sequence: Synthetic coding sequence

SEQ ID NO: 13682 - protein, 305 aa, Artificial Sequence
  Description of Artificial Sequence: Synthetic coding sequence
MSFLRITPSTHSSVSSGLLRLSIFLLLSFPDSNGKAIWTAHLNITFQVGNEITSELGESGVFGNHSPLERVSGVVALPEGWNQNACHPLTNFSRPKQADSWLALIERGGCTFTHKINVAAEKGANGVIIYNYQGTGSKVFPMSHQGTENIVAVMISNLKGMEILHSIQKGVYVTVIIEVGRMHMQWVSHYIMYLFTFLAATIAYFYLDCVWRLTPRVPNSFTRRRSQIKTDVKKAIDQLQLRVLKEGDEELDLNEDNCVVCFDTYKPQDVVRILTCKHFFHKACIDPWLLAHRTCPMCKCDILKT

SEQ ID NO: 13683 - protein, 400 aa, Artificial Sequence
  Description of Artificial Sequence: Synthetic coding sequence
MAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQSHRKETKKVIGQLLLHTVKHGEKGIDVDAENCAVCIENFKVKDIIRILPCKHIFHRICIDPWLLDHRTCPMCKLDVIKALGYWGEPGDVQEMPAPESPPGRDPAANLSLALPDDDGSDDSSPPSASPAESEPQCDPSFKGDAGENTALLEAGRSDSRHGGPIS

SEQ ID NO: 13684 - protein, 396 aa, Artificial Sequence
  Description of Artificial Sequence: Synthetic coding sequence
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 13685 - protein, 297 aa, Artificial Sequence
  Description of Artificial Sequence: Synthetic coding sequence
MSSHAQPLKLISPCPYSLSSGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 13686 - protein, 297 aa, Artificial Sequence; identical to SEQ ID NO: 13685
  Description of Artificial Sequence: Synthetic coding sequence

SEQ ID NO: 13687 - protein, 405 aa, Artificial Sequence
  Description of Artificial Sequence: Synthetic coding sequence
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEFCHT

SEQ ID NO: 13688 - protein, 438 aa, Artificial Sequence
  Description of Artificial Sequence: Synthetic coding sequence
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 13689 - protein, 203 aa, Artificial Sequence
  Description of Artificial Sequence: Synthetic coding sequence
METLSQDSLLECQICFNYYSPRRRPKLLDCKHTCCSVCLQQMRTSQKDVRCPWCRGVTKLPPGFSVSQLPDDPEVLAVIAIPHTSEHTPVFIKLPSNGCYMLPLPISKERALLPGDMGCRLLPGSQQKSVTVVTIPAEQQPLQGGAPQEAVEEEQDRRGVVKSSTWSGVCTVILVACVLVFLLGIVLHNMSCISKRFTVISCG

SEQ ID NO: 13690 - protein, 350 aa, Artificial Sequence [sequence omitted]

SEQ ID NO: 13691 - protein, 162 aa, Artificial Sequence
  Description of Artificial Sequence: Synthetic coding sequence
MHLLPLDSSSTLTCTVPSACTKPPSRWRPTVDIFFVVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 13692 - protein, 200 aa, Artificial Sequence
  Description of Artificial Sequence: Synthetic coding sequence
MAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTGSSEKSSRASEQTHQEAVACLDTQNSPACTVGCRSGPQHIPHDRMLPSASPRLCFTLLDCVSILWFSG

SEQ ID NO: 13693 - protein, 45 aa, Artificial Sequence
  Description of Artificial Sequence: Synthetic coding sequence
MAKYQGEVQSLKLDDDSVIEGVSDQVLVAVVVSFALIATLVYALF

SEQ ID NO: 13694 - protein, 258 aa, Artificial Sequence
  Description of Artificial Sequence: Synthetic coding sequence
MAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 13695 - protein, 115 aa, Artificial Sequence
  Description of Artificial Sequence: Synthetic coding sequence
MAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYW

SEQ ID NO: 13696 - protein, 258 aa, Artificial Sequence; identical to SEQ ID NO: 13694
  Description of Artificial Sequence: Synthetic coding sequence

SEQ ID NO: 13697 - protein, 174 aa, Artificial Sequence
  Description of Artificial Sequence: Synthetic coding sequence
MYCPICLHQASFPVETNCGHLFCGACIIAYWRYGSWLGAISCPICRQTVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 13698 - protein, 181 aa, Artificial Sequence
  Description of Artificial Sequence: Synthetic coding sequence
MADPTILVYKWFLLIYKLSYAFGVVGYLAIMFTMCGFNLFFKIKARDSMDFGIVSLFYGLYYGVMGRDFAEICSDYMASTIGFYSVSRLPTRSLSDNICAVCGQKIIVELDEEGLIENTYQLSCNHVYPFQRKLFGLHQASFFPPSPPPPPVPISSILLTFHAQTPVLYPPAQSSLPVCPC

SEQ ID NO: 13699 - protein, 328 aa, Artificial Sequence
  Description of Artificial Sequence: Synthetic coding sequence
MAAGTAARKAAPVLEAPPQQEQLSHTKLSAEDTWNLQQERMYKMHRGHDSMHVEMILIFLCVLVIAQIVLVQWRQRHGRSYNLVTLLQMWVVPLYFTIKLYWWRFLSMWGMFSVITSYILFRATRKPLSGRTPRLVYKWFLLIYKLSYAFGVVGYLAIMFTMCGFNLFFKIKARDSMDFGIVSLFYGLYYGVMGRDFAEICSDYMASTIGFYSVSRLPTRSLSDNICAVCGQKIIVELDEEGLIENTYQLSCNHVFHEFCIRGWCIVGKKQTCPYCKEKVDLKRMISNPWERTHFLYGQILDWLRYLVAWQPVVIGIVQGIIYSLGLE

SEQ ID NO: 13700 - protein, 416 aa, Artificial Sequence
  Description of Artificial Sequence: Synthetic coding sequence
MKRSKELITKNHSQEETSILRCWKCRKCIASSGCFMEYLENQVIKDKDDSVDAQNICHVWHMNVEALPEWISCLIQKAQWTVGKLNCPFCGARLGGFNFVSTPKCSCGQLAAVHLSKSRTDYQPTQAGRLMRPSVKYLSHPRVQSGCDKEALLTGGGSENRNHRLLNMARNNNDPGRLTEALCLEVRPTYFEMKNEKLLSKASEPKYQLFVPQLVTGRCATRAFHRKSHSLDLNISEKLTLLPTLYEIHSKTTAYSRLNETQPIDLSGLPLQSSKNSYSFQNPSSFDPSMLLQRFSVAPHETQTQRGGEFQCGLEAASVYSDHTNTNNLTFLMDLPSAGRSMPEASDQEEHLSPLDFLHSANFSLGSINQRLNKRERSKLKNLRRKQRRRERWLQKQGKYSGVGLLDHMVSIYLLI

SEQ ID NO: 13701 - protein, 96 aa, Artificial Sequence
  Description of Artificial Sequence: Synthetic coding sequence
MKRSKELITKNHSQEETSILRCWKCRKCIASSGCFMEYLENQVIKDKDDSVDAQNICHVWHMNVEALPEWISCLIQKGKYSGVGLLDHMVSIYLLI

SEQ ID NO: 13702 - protein, 592 aa, Artificial Sequence
  Description of Artificial Sequence: Synthetic coding sequence
MKRSKELITKNHSQEETSILRCWKCRKCIASSGCFMEYLENQVIKDKDDSVDAQNICHVWHMNVEALPEWISCLIQKAQWTVGKLNCPFCGARLGGFNFVSTPKCSCGQLAAVHLSKSRTDYQPTQAGRLMRPSVKYLSHPRVQSGCDKEALLTGGGSENRNHRLLNMARNNNDPGRLTEALCLEVRPTYFEMKNEKLLSKASEPKYQLFVPQLVTGRCATRAFHRKSHSLDLNISEKLTLLPTLYEIHSKTTAYSRLNETQPIDLSGLPLQSSKNSYSFQNPSSFDPSMLLQRFSVAPHETQTQRGGEFQCGLEAASVYSDHTNTNNLTFLMDLPSAGRSMPEASDQEEHLSPLDFLHSANFSLGSINQRLNKRERSKLKNLRRKQRRRERWLQKQGKYSGVGLLDHMTLNNEMSTDEDNEYAEEKDSYICAVCLDVYFNPYMCYPCHHIFCEPCLRTLAKDNPSSTPCPLCRTIISRVFFQTELNNATKTFFTKEYLKIKQSFQKSNSAKWPLPSCRKAFHLFGGFRRHAAPVTRRQFPHGAHRMDYLHFEDDSRGWWFDMDMVIIYIYSVNWVIGFIVFCFLCYFFFPF

SEQ ID NO: 13703 - protein, 107 aa, Artificial Sequence
  Description of Artificial Sequence: Synthetic coding sequence
MKRSKELITKNHSQEETSILRCWKCRKCIASSGCFMEYLENQVIKDKDDSVDAQNICHVWHMNVEALPEWISCLIQKAQWTVGKLNCPFCGARLGGFNFVSTPKCSC

SEQ ID NO: 13704 - protein, 162 aa, Artificial Sequence
  Description of Artificial Sequence: Synthetic coding sequence
MASQPPEDTAESQASDELECKICYNRYNLKQRKPKVLECCHRVCAKCLYKIIDFGDSPQGVIVCPFCRFETCLPDDEVSSLPDDNNILVNLTCGGKGKKCLPENPTELLLTPKRLASLVSPSHTSSNCLVITIMEVQRESSPSLSSTPVVEFYRPASFDSVT

SEQ ID NO: 13705 - protein, 82 aa, Artificial Sequence
  Description of Artificial Sequence: Synthetic coding sequence
MASQPPEDTAESQASDELECKICYNRYNLKQRKPKVLECCHRVCAKCLYKIIDFGDSPQGVIVCPFCRFETCLPDDEVSSLP

SEQ ID NO: 13706 - protein, 13 aa, Artificial Sequence
  Description of Artificial Sequence: Synthetic coding sequence
MASQPPEDTAESQ

SEQ ID NO: 13707 - protein, 247 aa, Artificial Sequence
  Description of Artificial Sequence: Synthetic coding sequence
MASQPPEDTAESQASDELECKICYNRYNLKQRKPKVLECCHRVCAKCLYKIIDFGDSPQGVIVCPFCRFETCLPDDEVSSLPDDNNILVNLTCGGKGKKCLPENPTELLLTPKRLASLVSPSHTSSNCLVITIMEVQRESSPSLSSTPVVEFYRPASFDSVTTVSHNWTVWNCTSLLFQTSIRVLVWLLGLLYFSSLPLGIYLLVSKKVTLGVVFVSLVPSSLVILMVYGFCQCVCHEFLDCMAPPS

SEQ ID NO: 13708 - protein, 51 aa, Artificial Sequence
  Description of Artificial Sequence: Synthetic coding sequence
MASQPPEDTAESQASDELECKICYNRYNLKQRKPKVLECCHRVCAKCLYKI

SEQ ID NO: 13709 - protein, 247 aa, Artificial Sequence; identical to SEQ ID NO: 13707
  Description of Artificial Sequence: Synthetic coding sequence

SEQ ID NO: 13710 - protein, 247 aa, Artificial Sequence; identical to SEQ ID NO: 13707
  Description of Artificial Sequence: Synthetic coding sequence

SEQ ID NO: 13711 - protein, 247 aa, Artificial Sequence; identical to SEQ ID NO: 13707
  Description of Artificial Sequence: Synthetic coding sequence

SEQ ID NO: 13712 - protein, 192 aa, Artificial Sequence
  Description of Artificial Sequence: Synthetic coding sequence
MASKGPSASASPENSSAGGPSGSSNGAGESGGQDSTFECNICLDTAKDAVISLCGHLFCWPCLHQWLETRPNRQVCPVCKAGISRDKVIPLYGRGSTGQQDPREKTPPRPQGQRPEPENRGGFQGFGFGDGGFQMSFGIGAFPFGIFATAFNINDGRPPPAVPGTPQYVDEQFLSRLFLFVALVIMFWLLIA

SEQ ID NO: 13713 - protein, 130 aa, Artificial Sequence
  Description of Artificial Sequence: Synthetic coding sequence
MALARAEGRTALSSATSAWTQPRMPSSACVATSSVGRVYIREKTPPRPQGQRPEPENRGGFQGFGFGDGGFQMSFGIGAFPFGIFATAFNINDGRPPPAVPGTPQYVDEQFLSRLFLFVALVIMFWLLIA

SEQ ID NO: 13714 - protein, 157 aa, Artificial Sequence
  Description of Artificial Sequence: Synthetic coding sequence
MASKGPSASASPENSSAGGPSGSSNGAGESGGQDSTFECNICLDTAKDAVISLCGHLFCWPCLHQWLETRPNRQVCPVCKAGISRDKVIPLYGRGSTGQQDPREKTPPRPQGQRPEPENRGVRNILGEASTNELMALEVSFLALQFFSLIIKVKENL

SEQ ID NO: 13715 - protein, 192 aa, Artificial Sequence; identical to SEQ ID NO: 13712
  Description of Artificial Sequence: Synthetic coding sequence

SEQ ID NO: 13716 - protein, 136 aa, Artificial Sequence
  Description of Artificial Sequence: Synthetic coding sequence
MASKGPSASASPENSSAGGPSGSSNGAGESGGQDSTFECNICLDTAKDAVISLCGHLFCWPCLHQGFQGFGFGDGGFQMSFGIGAFPFGIFATAFNINDGRPPPAVPGTPQYVDEQFLSRLFLFVALVIMFWLLIA

SEQ ID NO: 13717 - protein, 838 aa, Artificial Sequence
  Description of Artificial Sequence: Synthetic coding sequence
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRIEISESRVNISCPECTERFNPHDIRLILSDDVLMEKYEEFMLRRWLVADPDCRWCPAPDCGYAVIAFGCASCPKLTCGREGCGTEFCYHCKQIWHPNQTCDAARQERAQSLRLRTIRSSSISYSQESGAAADDIKPCPRCAAYIIKMNDGSCNHMTCAVCGCEFCWLCMKEISDLHYLSPSGCTFWGKKPWSRKKKILWQLGTLVGAPVGIALIAGIAIPAMIIGIPVYVGRKIHNRYEGKDVSKHKRNLAIAGGVTLSVIVSPVVAAVTVGIGVPIMLAYVYGVVPISLCRSGGCGVSAGNGKGVRIEFDDENDINVGGTNTAVDTTSVAEARHNPSIGEGSVGGLTGSLSASGSHMDRIGAIRDNLSETASTMALAGASITGSLSGSAMVNCFNRLEVQADVQKERYSLSGESGTVSLGTVSDNASTKAMAGSILNSYIPLDKEGNSMEVQVDIESKPSKFRHNSGSSSVDDGSATRSHAGGSSSGLPEGKSSATKWSKEATAGKKSKSGKLRKKGNMKINETREDMDAQLLEQQSTNSSEFEAPSLSDSMPSVADSHSSHFSEFSCSDLESMKTSCSHGSSDYHTRFATVNILPEVENDRLENSPHQCSISVVTQTASCSEVSQLNHIAEEHGNNGIKPNVDLYFGDALKETNNNHSHQTMELKVAIQTEI

SEQ ID NO: 13718 - protein, 89 aa, Artificial Sequence
  Description of Artificial Sequence: Synthetic coding sequence
MQEQEIGFISKYNEGLCVNTDPVSILTSILDMSLHRQMGSDRDLQSSASSVSLPSVKKAPKKRRISIGSLFRRKKDNKRKSRELNGGVD

SEQ ID NO: 13719 - protein, 838 aa, Artificial Sequence; identical to SEQ ID NO: 13717
  Description of Artificial Sequence: Synthetic coding sequence

SEQ ID NO: 13720 - protein, 165 aa, Artificial Sequence
  Description of Artificial Sequence: Synthetic coding sequence
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRI

SEQ ID NO: 13721 - protein, 113 aa, Artificial Sequence
  Description of Artificial Sequence: Synthetic coding sequence
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNT

SEQ ID NO: 13722 - protein, 156 aa, Artificial Sequence
  Description of Artificial Sequence: Synthetic coding sequence
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCV

SEQ ID NO: 13723 - protein, 15 aa, Artificial Sequence
  Description of Artificial Sequence: Synthetic coding sequence
MQEQEIGFISKYNEG

SEQ ID NO: 13724 - protein, 731 aa, Artificial Sequence
  Description of Artificial Sequence: Synthetic coding sequence
MGSEKDSESPRSTSLHAAAPDPKCRSGGRRRRLTLHSVFSASARGRRARAKPQAEPPPPAAQPPPAPAPAAAQGPPPEALPAEPAAEAEAEAAAAAAEPGFDDEEAAEGGGPGAEEVECPLCLVRLPPERAPRLLSCPHRSCRDCLRHYLRLEISESRVPISCPECSERLNPHDIRLLLADPPLMHKYEEFMLRRYLASDPDCRWCPAPDCGYAVIAYGCASCPKLTCEREGCQTEFCYHCKQIWHPNQTCDMARQQRAQTLRVRTKHTSGLSYGQESGPDDIKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVGIGVPIMLAYVYGVVPISLCRGGGCGVSTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRECNNMEIQVDIEAKPSHYQLVSGSSTEDSLHVHAQMAENEEEGSGGGGSEEDPPCRHQSCEQKDCLASKPWDISLAQPESIRSDLESSDAQSDDVPDITSDECGSPRSHTAACPSTPRAQGAPSPSAHMNLSALAEGQTVLKPEGGEARV

SEQ ID NO: 13725 - protein, 587 aa, Artificial Sequence
  Description of Artificial Sequence: Synthetic coding sequence
MGSEKDSESPRSTSLHAAAPDPKCRSGGRRRRLTLHSVFSASARGRRARAKPQAEPPPPAAQPPPAPAPAAAQGPPPEALPAEPAAEAEAEAAAAAAEPGFDDEEAAEGGGPGAEEVECPLCLVRLPPERAPRLLSCPHRSCRDCLRHYLRLEISESRVPISCPECSERLNPHDIRLLLADPPLMHKYEEFMLRRYLASDPDCRWCPAPDCGYAVIAYGCASCPKLTCEREGCQTEFCYHCKQIWHPNQTCDMARQQRAQTLRVRTKHTSGLSYGQESGPDDIKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVGIGVPIMLAYVYGVVPISLCRGGGCGVSTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRFSMIHA

SEQ ID NO: 13726 - protein, 732 aa, Artificial Sequence
  Description of Artificial Sequence: Synthetic coding sequence
MGSEKDSESPRSTSLHAAAPDPKCRSGGRRRRLTLHSVFSASARGRRARAKPQAEPPPPAAQPPPAPAPAAAQGPPPEALPAEPAAEAEAEAAAAAAEPGFDDEEAAEGGGPGAEEVECPLCLVRLPPERAPRLLSCPHRSCRDCLRHYLRLEISESRVPISCPECSERLNPHDIRLLLADPPLMHKYEEFMLRRYLASDPDCRWCPAPDCGYAVIAYGCASCPKLTCEREGCQTEFCYHCKQIWHPNQTCDMARQQRAQTLRVRTKHTSGLSYGQESGPADDIKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVGIGVPIMLAYVYGVVPISLCRGGGCGVSTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRECNNMEIQVDIEAKPSHYQLVSGSSTEDSLHVHAQMAENEEEGSGGGGSEEDPPCRHQSCEQKDCLASKPWDISLAQPESIRSDLESSDAQSDDVPDITSDECGSPRSHTAACPSTPRAQGAPSPSAHMNLSALAEGQTVLKPEGGEARV

SEQ ID NO: 13727 - protein, 486 aa, Artificial Sequence
  Description of Artificial Sequence: Synthetic coding sequence
MGSEKDSESPRSTSLHAAAPDPKCRSGGRRRRLLSCPHRSCRDCLRHYLRLEISESRVPISCPECSERLNPHDIRLLLADPPLMHKYEEFMLRRYLASDPDCRWCPAPDCGYAVIAYGCASCPKLTCEREGCQTEFCYHCKQIWHPNQTCDMARQQRAQTLRVRTKHTSGLSYGQESGPDDIKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVGIGVPIMLAYVYGVVPISLCRGGGCGVSTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRSSMPHV

SEQ ID NO: 13728 - protein, 377 aa, Artificial Sequence
  Description of Artificial Sequence: Synthetic coding sequence
MGPAARPALRSPPPPPPPPPSPLLLLLPLLPLWLGLAGPGAAADGSEPAAGAGRGGARAVRVDVRLPRQDALVLEGVRIGSEADPAPLLGGRLLLMDIVDAEQEAPVEGWIAVAYVGKEQAAQFHQENKGSGPQAYPKALVQQMRRALFLGASALLLLILNHNVVRELDISQLLLRPVIVLHYSSNVTKLLDALLQRTQATAEITSGESLSANIEWKLTLWTTCGLSKDGYGGWQDLVCLGGSRAQEQKPLQQLWNAILLVAMLLCTGLVVQAQRQASRQSQRELGGQVDLFKRRVVRRLASLKTRRCRLSRAAQGLPDPGAETCAVCLDYFCNKQWLRVLPCKHEFHRDCVDPWLMLQQTCPLCKFNVLGNRYSDD

SEQ ID NO: 13729 - protein, 186 aa, Artificial Sequence
  Description of Artificial Sequence: Synthetic coding sequence
MAPCTETKIFVLCDEQIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIGLFVFPIYCLCKKQRKRSRTGMHW

SEQ ID NO: 13730 - protein, 275 aa, Artificial Sequence
  Description of Artificial Sequence: Synthetic coding sequence
MKVQLGQVEIKCPITECFEFLEETTVVYNLTHEDSIKYKYFLELGRIDSSTKPCPQCKHFTTFKKKGHIPTPSRSESKYKIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIVEEIKTYWNLISGRTRNQTQHLAPQPVLLSDMLYCLKQVFICISYLLPL

SEQ ID NO: 13731 - protein, 2 aa, Artificial Sequence
  Description of Artificial Sequence: Synthetic coding sequence
MK

SEQ ID NO: 13732 - protein, 307 aa, Artificial Sequence
  Description of Artificial Sequence: Synthetic coding sequence
MPSLLGAPPYSGLGGVGDPYVPLMVLMCRVCLEDKPIKPLPCCKKAVCEECLKVYLSAQVQLGQVEIKCPITECFEFLEETTVVYNLTHEDSIKYKYFLELGRIDSSTKPCPQCKHFTTFKKKGHIPTPSRSESKYKIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIGLFVFPIYCLCKKQRKRSRTGMHW

SEQ ID NO: 13733 - protein, 249 aa, Artificial Sequence
  Description of Artificial Sequence: Synthetic coding sequence
MSSGQQVWHTAVPPPRRSSSIASMPRSPSSAGSPRSPGTPGSERVASPLECSICFSGYDNIFKTPKELSCTHVFCLECLARLAAAQPVGRPGGEAVPCPFCRQPTAVPPAGAPALCTSRQLQARMPAHLRREEPVWLEGTKLCCQPLPTTPGREPGFVCVDVGLSKPAEPPAPARDPAPRRGRLARCWARCRDWRRMALVSALLLMLFCVALWPVQCALKTGNLRCLPLPPRPPATSTAASPLGPLTDN

SEQ ID NO: 13734 - protein, 1001 aa, Artificial Sequence
  Description of Artificial Sequence: Synthetic coding sequence
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNERLKVALRSLPEEVVRETGEYRMLQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELQEREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 13735 - protein, 901 aa, Artificial Sequence
  Description of Artificial Sequence: Synthetic coding sequence
MSGPGNKRAAGDGGSGPPEKKLSREEKTTTTLIEPIRLGGISSTEEMDLKVLQFKNKKLAERLEQRQACEDELRERIEKLEKRQATDDATLLIVNRYWAQLDETVEALLRCHESQGELSSAPEAPGTQEGPTCDGTPLPEPGTSELRDPLLMQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKSDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELQEREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 13736 - protein, 693 aa, Artificial Sequence
  Description of Artificial Sequence: Synthetic coding sequence
MSGPGNKRAAGDGGSGPPEKKLSREEKTTTTLIEPIRLGGISSTEEMDLKVLQFKNKKLAERLEQRQACEDELRERIEKLEKRQAQFSLLYNESLQVKTQLDEARGLLLATKNSHLRHIEHMESDELGLQKKLRTEVIQLEDTLAQVRKEYEMLRIEFEQNLAANEQAGPINREMRHLISSLQNHNHQLKGDAQRYKRKLREVQAEIGKLRAQASGSAHSTPNLGHPEDSGVSAPAPGKEEGGPGPVSTPDNRKEMAPVPGTTTTTTSVKKEELVPSEEDFQGITPGAQGPSSRGREPEARPKRELQEREGPSLGPPPVASALSRADREKAKVEETKRKESELLKGLRAELKKAQESQKEMKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKARLTCPCCNTRKKDAVLTKCFHVFCFECVRGRYEARQRKCPKCNAAFGAHDFHRIYIS

SEQ ID NO: 13737 - protein, 230 aa, Artificial Sequence
  Description of Artificial Sequence: Synthetic coding sequence
MQLRPPLSEPALAFVVALGASSSEEVELELQGRMEFSKAAVSRVVEASDRLQRRVEELCQRVYSRGDSEPLSEAAQAHTRELGRENRRLQDLATQLQEKHHRISLEYSELQDKVTSAETKVLEMETTVEDLQWDIEKLRKREQKLNKHLAEALEQLNSGYYVSGSSSGFQGGQITLSMQKFEMLNAELEENQELANSRMAELEKLQAELQGAVRTNFQSFQLEELPPDTL

SEQ ID NO: 13738 - protein, 307 aa, Artificial Sequence
  Description of Artificial Sequence: Synthetic coding sequence
MKLLLDMYKSAPKEQRDKVQLMAAERKAKAEVDELRSRIRELEERDRRESKKIADEDALRRIRQAEEQIEHLQRKLGATKQEEEALLSEMDVTGQAFEDMQEQNGRLLQQLREKDDANFKLMSERIKANQIHKLLREEKDELGEQVLGLKSQVDAQLLTVQKLEEKERALQGSLGGVEKELTLRSQALELNKRKAVEAAQLAEDLKVQLEHVQTRLREIQPCLAESRAAREKESFNLKRAQEDISRLRRKLEKQRKVEVYADADEILQEEIKEYKVGLWAKLCPIHLRIVDAGLLRLVESLGTLEVM

SEQ ID NO: 13739 - protein, 435 aa, Artificial Sequence
  Description of Artificial Sequence: Synthetic coding sequence
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRERSSKIQCAWLLVFLAGSSVLLYYTFHSQSLYYSLIFLNPTLDHLSFWEVFWIVGITDFILKFFFMGLKCLILLVPSFIMPFKSKGYWYMLLEELCQYYRTFVPIPVWFRYLISYGEFGNVTRWSLGILLALLYLILKLLEFFGHLRTFRQVLRIFFTQPSYGVAASKRQCSDVDDICSICQAEFQKPILLICQHIFCEECMTLWFNREKTCPLCRTVISDHINKWKDGATSSHLQIY

SEQ ID NO: 13740 - protein, 135 aa, Artificial Sequence
  Description of Artificial Sequence: Synthetic coding sequence
MQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITA

SEQ ID NO: 13741 - protein, 444 aa, Artificial Sequence
  Description of Artificial Sequence: Synthetic coding sequence
MWLFTVNQVLRKMQRRHSSNTDNIPPERNRSQALSSEASVDEGGVFESLKAEAASPPALFSGLSGSLPTSSFPSSLVLGSSAGGGDVFIQMPASREEGGGRGEGGAYHHRQPHHHFHHGGHRGGSLLQHVGGDHRGHSEEGGDEQPGTPAPALSELKAVICWLQKGLPFILILLAKLCFQHKLGIAVCIGMASTFAYANSTLREQVSLKEKRSVLVILWILAFLAGNTLYVLYTFSSQQLYNSLIFLKPNLEMLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGVRKALKLLCTSQNYGVRATGQQCTEAGDICAICQAEFREPLILLCQHVFCEECLCLWLDRERTCPLCRSVAVDTLRCWKDGATSAHFQVY

SEQ ID NO: 13742 - protein, 444 aa, Artificial Sequence; identical to SEQ ID NO: 13741
  Description of Artificial Sequence: Synthetic coding sequence

SEQ ID NO: 13743 - protein, 420 aa, Artificial Sequence
  Description of Artificial Sequence: Synthetic coding sequence
MWLFTVNQVLRKMQRRHSSNTDNIPPERNRSQALSSEASVDEGGVFESLKAEAASPPALFSGLSGSLPTSSFPSSLVLGSSAGGGDVFIQMPASREEGGGRGEGGAYHHRQPHHHFHHGGHRGGSLLQHVGGDHRGHSEEGGDEQPGTPAPALSELKAVICWLQKGLPFILILLAKLCFQHKLGIAVCIGMASTFAYANSTLREQVSLKEKRSVLVILWILAFLAGNTLYVLYTFSSQQLYNSLIFLKPNLEMLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGVRKALKLLCTSQNYGVRATGQQCTEAGDICAICQAEFREPLILLCQMLLKGHKKLELEKIDESAGV

SEQ ID NO: 13744 - protein, 403 aa, Artificial Sequence
  Description of Artificial Sequence: Synthetic coding sequence
MAAFLKMSVSVNFFRPFTRFLVPFTLHRKRNNLTILQRYMSSKIPAVTYPKNESTPPSEELELDKWKTTMKSSVQEECVSTISSSKDEDPLAATREFIEMWRLLGREVPEHITEEELKTLMECVSNTAKKKYLKYLYTKEKVKKARQIKKEMKAAAREEAKNIKLLETTEEDKQKNFLFLRLWDRNMDIAMGWKGAQAMQFGQPLVFDMAYENYMKRKELQNTVSQLLESEGWNRRNVDPFHIYFCNLKIDGALHRELVKRYQEKWDKLLLTSTEKSHVDLFPKDSIIYLTADSPNVMTTFRHDKVYVIGSFVDKSMQPGTSLAKAKRLNLATECLPLDKYLQWEIGNKNLTLDQMIRILLCLKNNGNWQEALQFVPKRKHTGFLEISQHSQEFINRLKKAKT

SEQ ID NO: 13745 - protein, 312 aa, Artificial Sequence
  Description of Artificial Sequence: Synthetic coding sequence
MAAFLKMSVSVNFFRPFTRFLVPFTLHRKRNNLTILQRYMSSKIPAVTYPKNESTPPSEELELDKWKTTMKSSVQEECVSTISSSKDEDPLAATREFIEMWRLLGREVPEHITEEELKTLMECVSNTAKKKYLKYLYTKEKVKKARQIKKEMKAAAREEAKNIKLLETTEEDKQKNFLFLRLWDRNMDIAMGWKGAQAMQFGQPLVFDMAYENYMKRKELQNTVSQLLESEGWNRRNVDPFHIYFCNLKIDGALHRELVKRYQEKWDKLLLTSTEKSHVDLFPKDSIIYLTADSPNVMTTFRHDKVYVIGSF

SEQ ID NO: 13746 - protein, 377 aa, Artificial Sequence
  Description of Artificial Sequence: Synthetic coding sequence
MAAPRWSASGPWIRGNGQGCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGGPGVQLCITDVLPILAKMLHGHKAEPLHLCHRLDKETTGVMVLAWDKDMAHQVQELFRTRQVVKKYWAITVHVPMPSAGVVDIPIVEKEAQGQQQHHKMTLSPSYRMDDGKMVKVRRSRNAQVAVTQYQVLSSTLSSALVELQPITGIKHQLRVHLSFGLDCPILGDHKYSDWNRLAPQKLSVGTLKKLGLEQSKARYIPLHLHARQLILPALGSGKEELNLVCKLPRFFVHSLHRLRLEMPNEDQNENNEAKCLGAQ

SEQ ID NO: 13747 - protein, 346 aa, Artificial Sequence
  Description of Artificial Sequence: Synthetic coding sequence
MAAPRWSASGPWIRGNGQGCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGGPGVQLCITDVLPILAKMLHGHKAEPLHLCHRLDKETTGVMVLAWDKDMAHQVQELFRTRQVVKKYWAITVHVPMPSAGVVDIPIVEKEAQVAVTQYQVLSSTLSSALVELQPITGIKHQLRVHLSFGLDCPILGDHKYSDWNRLAPQKLSVGTLKKLGLEQSKARYIPLHLHARQLILPALGSGKEELNLVCKLPRFFVHSLHRLRLEMPNEDQNENNEAKCLGAQ

SEQ ID NO: 13748 - protein, 365 aa, Artificial Sequence
  Description of Artificial Sequence: Synthetic coding sequence
MEGQSVEELLAKAEQDEAEKLQRITVHKELELQFDLGNLLASDRNPPTGLRCAGPTPEAELQALARDNTQLLINQLWQLPTERVEEAIVARLPEPTTRLPREKPLPRPRPLTRWQQFARLKGIRPKKKTNLVWDEVSGQWRRRWGYQRARDDTKEWLIEVPGNADPLEDQFAKRIQAKKERVAKNELNRLRNLARAHKMQLPSAAGLHPTGHQSKEELGRAMQVAKVSTASVGRFQERLPKEKVPRGSGKKRKFQPLFGDFAAEKKNQLELLRVMNSKKPQLDVTRATNKQMREEDQEEAAKRRKMSQKGKRKGGRQGPGGKRKGGPPSQGGKRKGGLGGKMNSGPPGLGGKRKGGQRPGGKRRK

SEQ ID NO: 13749 - protein, 708 aa, Artificial Sequence
  Description of Artificial Sequence: Synthetic coding sequence
MADREGGCAAGRGRELEPELEPGPGPGSALEPGEEFEIVDRSQLPGPGDLRSATRPRAAEGWSAPILTLARRATGNLSASCGSALRAAAGLGGGDSGDGTARAASKCQMMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKGHAWLKDDEATHCRQCEKEFSISRRKHHCRNCGHIFCNTCSSNELALPSYPKPVRVCDSCHTLLLQRCSSTAS

SEQ ID NO: 13750 - protein, 310 aa, Artificial Sequence
  Description of Artificial Sequence: Synthetic coding sequence
MYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKGHAWLKDDEATHCRQCEKEFSISRRKHHCRNCGHIFCNTCSSNELALPSYPKPVRVCDSCHTLLLQRCSSTAS

SEQ ID NO: 13751 - protein, 412 aa, Artificial Sequence
  Description of Artificial Sequence: Synthetic coding sequence
MADREGGCAAGRGRELEPELEPGPGPGSALEPGEEFEIVDRSQLPGPGDLRSATRPRAAEGWSAPILTLARRATGNLSASCGSALRAAAGLGGGDSGDGTARAASKCQMMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEEEERMKGQDKGGLSRGRELAASCPAVSLLDTSCLLLAGGGCSALLRLSTAFSCNRPNLLTSRRTAAVKRTK

SEQ ID NO: 13752 - protein, 600 aa, Artificial Sequence
  Description of Artificial Sequence: Synthetic coding sequence
MMEERANLMHMMKLSIKVLLQSALSLGRSLDADHAPLQQFFVVMEHCLKHGLKVKKSFIGQNKSFFGPLELVEKLCPEASDIATSVRNLPELKTAVGRGRAWLYLALMQKKLADYLKVLIDNKHLLSEFYEPEALMMEEEGMVIVGLLVGLNVLDANLCLKGEDLDSQVGVIDFSLYLKDVQDLDGGKEHERITDVLDQKNYVEELNRHLSCTVGDLQTKIDGLEKTNSKLQEELSAATDRICSLQEEQQQLREQNELIRERSEKSVEITKQDTKVELETYKQTRQGLDEMYSDVWKQLKEEKKVRLELEKELELQIGMKTEMEIAMKLLEKDTHEKQDTLVALRQQLEEVKAINLQMFHKAQNAESSLQQKNEAITSFEGKTNQVMSSMKQMEERLQHSERARQGAEERSHKLQQELGGRIGALQLQLSQLHEQCSSLEKELKSEKEQRQALQRELQHEKDTSSLLRMELQQVEGLKKELRELQDEKAELQKICEEQEQALQEMGLHLSQSKLKMEDIKEVNQALKGHAWLKDDEATHCRQCEKEFSISRRKHHCRNCGHIFCNTCSSNELALPSYPKPVRVCDSCHTLLLQRCSSTAS

SEQ ID NO: 13753 - protein, 600 aa, Artificial Sequence; identical to SEQ ID NO: 13752
  Description of Artificial Sequence: Synthetic coding sequence

SEQ ID NO: 13754 - protein, 608 aa, Artificial Sequence
  Description of Artificial Sequence: Synthetic coding sequence
AWAARLGRPGRSCLPGARGRAPPPPPLLLLLALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSSLGYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 13755 - protein, 418 aa, Artificial Sequence [sequence omitted]

SEQ ID NO: 13756 - protein, 587 aa, Artificial Sequence
  Description of Artificial Sequence: Synthetic coding sequence
  MOD_RES (1)..(1): Any amino acid
XRAPPPPPLLLLLALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 13757 - protein, 79 aa, Artificial Sequence
  Description of Artificial Sequence: Synthetic coding sequence
MSTKKSPEELKRIFEKYAAKEGDPDQLSKDELKLLIQAEFPSLLKGPNTLDDLFQELDKNGDGEVSFEEFQVLVKKISQ

SEQ ID NO: 13758 - protein, 241 aa, Artificial Sequence
  Description of Artificial Sequence: Synthetic coding sequence
MNGTLTAVESFLTIHSGPEGLSIHDGTWKSAIYGFGDQSNLRKLRNVSNLKPVPLIGPKLKRRWPISYCRELKGYSIPFMGSDVSVVRRTQRYLYENLEESPVQYAAYVTVGGITSVIKLMFAGLFFLFFVRFGIGRQLLIKIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 13759 - protein, 429 aa, Artificial Sequence
  Description of Artificial Sequence: Synthetic coding sequence
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGTLTAVESFLTIHSGPEGLSIHDGTWKSAIYGFGDQSNLRKLRNVSNLKPVPLIGPKLKRRWPISYCRELKGYSIPFMGSDVSVVRRTQRYLYENLEESPVQYAAYVTVGGITSVIKLMFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 13760 - protein, 357 aa, Artificial Sequence
  Description of Artificial Sequence: Synthetic coding sequence
MSGKTKARRAAMFFRRCSEDASGSASGNALLSEDENPDANGVTRSWKIILSTMLTLTFLLVGLLNHQWLKETDVPQKSRQLYAIIAEYGSRLYKYQARLRMPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQHAVSEYLLCVKLNIFSNWGHPKYTCLYRFRVHGTPGKHI

SEQ ID NO: 13761 - protein, 357 aa, Artificial Sequence; identical to SEQ ID NO: 13760
  Description of Artificial Sequence: Synthetic coding sequence

SEQ ID NO: 13762 - protein, 269 aa, Artificial Sequence
  Description of Artificial Sequence: Synthetic coding sequence
MPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYVQRYMCRFVIQAGITKKCEGEEIFLGQFIYNKTGTTVQTFELQHAVSEYLLCVKLNIFSNWGHPKYTCLYRFRVHGTPGKHI

SEQ ID NO: 13763 - protein, 269 aa, Artificial Sequence; identical to SEQ ID NO: 13762
  Description of Artificial Sequence: Synthetic coding sequence

SEQ ID NO: 13764 - protein, 281 aa, Artificial Sequence
  Description of Artificial Sequence: Synthetic coding sequence
  MOD_RES (1)..(1): Any amino acid
XYAIIAEYGSRLYKYQARLRMPKEQLELLKKESQNLENNFRQILFLIEQIDVLKALLRDMKDGMDNNHNWNTHGDPVEDPDHTEVLDEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQHAVSEYLLCVKLNIFSNWGHPKYTCLYRFRVHGTPGKHI

SEQ ID NO: 13765 - protein, 345 aa, Artificial Sequence
  Description of Artificial Sequence: Synthetic coding sequence
MEDYSKYNAYTDFSSCRLECSGAILAHCNLHLLGSSISPASASRVAGTTGLLNHQWLKETDVPQKSRQLYAIIAEYGSRLYKYQARLRMPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQHAVSEYLLCVKLNIFSNWGHPKYTCLYRFRVHGTPGKHI

SEQ ID NO: 13766 - protein, 312 aa, Artificial Sequence
  Description of Artificial Sequence: Synthetic coding sequence
MDRSTNLDIEELKMTREQYILATQQNNLPRTENAQLYPVGIYGWRKRCLYFFVLLLLVTMIVNLAMTIWILKVMNFTVDGMGNLRVTKKGIRLEGISEFLLPLYVKEIHSRKDSPLVLQSDRNVTVNARNHMGQLTGQLTIGADAVEAQCKRFEVRASEDGRVLFSADEDEITIGAEKLKVTGTEGAVFGHSVETPHIRAEPSQDLRLESPTRSLIMEAPRGVQVSAAAGDFKATCRKELHLQSTEGEIFLNAETIKLGNLPTGSFSSSSPSSSSSRQTVYELCVCPNGKLYLSPAGVGSTCQSSSNICLWS

SEQ ID NO: 13767 - protein, 265 aa, Artificial Sequence
  Description of Artificial Sequence: Synthetic coding sequence
MTREQYILATQQNNLPRTENAQLYPVGIYGWRKRCLYFFVLLLLVTMIVNLAMTIWILKVMNFTVDSPLVLQSDRNVTVNARNHMGQLTGQLTIGADAVEAQCKRFEVRASEDGRVLFSADEDEITIGAEKLKVTGTEGAVFGHSVETPHIRAEPSQDLRLESPTRSLIMEAPRGVQVSAAAGDFKATCRKELHLQSTEGEIFLNAETIKLGNLPTGSFSSSSPSSSSSRQTVYELCVCPNGKLYLSPAGVGSTCQSSSNICLWS

SEQ ID NO: 13768 - protein, 811 aa, Artificial Sequence
  Description of Artificial Sequence: Synthetic coding sequence
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 13769 - protein, 811 aa, Artificial Sequence; identical to SEQ ID NO: 13768
  Description of Artificial Sequence: Synthetic coding sequence

SEQ ID NO: 13770 - protein, 506 aa, Artificial Sequence
  Description of Artificial Sequence: Synthetic coding sequence
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLGIQVDDFLPKINGSTEKEKLIVEGHLTKAVEETKLSKENQTRAKESDFSDTLSPSKEKSSDDTTDAQMDEQDLNEPLAKVSLLKGTLTCFYDIVNQGIKSPFAIKSVLDIM

SEQ ID NO: 13771 - protein, 271 aa, Artificial Sequence
  Description of Artificial Sequence: Synthetic coding sequence
MDEQDLNEPLAKVSLLKALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEVKRKDIMSPIMVGLKAKSKSDIHAS

SEQ ID NO: 13772 - protein, 409 aa, Artificial Sequence
  Description of Artificial Sequence: Synthetic coding sequence
  MOD_RES (1)..(1): Any amino acid
XKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 13773 - protein, 828 aa, Artificial Sequence
  Description of Artificial Sequence: Synthetic coding sequence
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 13774 - protein, 316 aa, Artificial Sequence
  Description of Artificial Sequence: Synthetic coding sequence
  MOD_RES (1)..(1): Any amino acid
XGHLTKAVEETKLSKENQTRAKESDFSDTLSPSKEKSSDDTTDAQMDEQDLNEPLAKVSLLKALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEVKRKDIMSPIMVGLKAKSKSDIHAS

SEQ ID NO: 13775 - protein, 296 aa, Artificial Sequence
  Description of Artificial Sequence: Synthetic coding sequence
MDEQDLNEPLAKVSLLKAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 13776 - protein, 790 aa, Artificial Sequence
  Description of Artificial Sequence: Synthetic coding sequence
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQEKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 13777 - protein, 318 aa, Artificial Sequence
  Description of Artificial Sequence: Synthetic coding sequence
MDEQDLNEPLAKVSLLKALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 13778 - protein, 362 aa, Artificial Sequence
  Description of Artificial Sequence: Synthetic coding sequence
MDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 13779 - protein, 451 aa, Artificial Sequence
  Description of Artificial Sequence: Synthetic coding sequence
MEEKEQELQAKIEALQADNDFTNERLTALQENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPRIHRPIPGFPVLVFRSIVVEQKPWPWMPMLAALVAVTAIVLYVPGLARASP

SEQ ID NO: 13780 - protein, 183 aa, Artificial Sequence
  Description of Artificial Sequence: Synthetic coding sequence
MEQRLAEFRAARKRAGLAAQPPAASQGAQTPGEKAEAAATLKAAPGWLKRFLVWKPRPASARAQPGLVQEAAQPQGSTSETPWNTAIPLPSCWDQSFLTNITFLKVLLWLVLLGLFVELEFGLAYFVLSLFYWMYVGTRGPEEKKEGEKSAYSVFNPGCEAIQGTLTAEQLERELQLRPLAGR

SEQ ID NO: 13781 - protein, 116 aa, Artificial Sequence
  Description of Artificial Sequence: Synthetic coding sequence
MLEAAQPQGSTSETPWNTAIPLPSCWDQSFLTNITFLKVLLWLVLLGLFVELEFGLAYFVLSLFYWMYVGTRGPEEKKEGEKSAYSVFNPGCEAIQGTLTAEQLERELQLRPLAGR

SEQ ID NO: 13782 - protein, 357 aa, Artificial Sequence
  Description of Artificial Sequence: Synthetic coding sequence
MENKAMYLHTVSDCDTSSICEDSFDGRSLSKLNLCEDVSRPRSSPDDLKALTRNVNRLNESFRDLQLRLLQAPLQADLTEQVWKVQDALQNQSDSLLALAGAVQRLEGALWGLQAQAVQTEQAVALLRDRTGQQSDTAQLELYQLQVESNSSQLLLRRHAGLLDGLARRVGILGEELADVGGVLRGLNHSLSYDVALHRTRLQDLRVLVSNASEDTRRLRLAHVGMELQLKQELAMLNAVTEDLRLKDWEHSIALRNISLAKGPPGPKGDQGDEGKEGRPGIPGLPGLRGLPGERGTPGLPGPKGDDGKLGATGPMGMRGFKGDRGPKGEKGEKGDRAGDASKDILLGPWDMVLAQG

SEQ ID NO: 13783 - protein, 495 aa, Artificial Sequence
  Description of Artificial Sequence: Synthetic coding sequence
MENKAMYLHTVSDCDTSSICEDSFDGRSLSKLNLCEDGPCHKRRASICCTQLGSLSALKHAVLGLYLLVFLILVGIFILAVSRPRSSPDDLKALTRNVNRLNESFRDLQLRLLQAPLQADLTEQVWKVQDALQNQSDSLLALAGAVQRLEGALWGLQAQAVQTEQAVALLRDRTGQQSDTAQLELYQLQVESNSSQLLLRRHAGLLDGLARRVGILGEELADVGGVLRGLNHSLSYDVALHRTRLQDLRVLVSNASEDTRRLRLAHVGMELQLKQELAMLNAVTEDLRLKDWEHSIALRNISLAKGPPGPKGDQGDEGKEGRPGIPGLPGLRGLPGERGTPGLPGPKGDDGKLGATGPMGMRGFKGDRGPKGEKGEKGDRAGDASGVEAPMMIRLVNGSGPHEGRVEVYHDRRWGTVCDDGWDKKDGDVVCRMLGFRGVEEVYRTARFGQGTGRIWMDDVACKGTEETIFRCSFSKWGVTNCGHAEDASVTCNRH

SEQ ID NO: 13784 - protein, 270 aa, Artificial Sequence
  Description of Artificial Sequence: Synthetic coding sequence
MENKAMYLHTVSDCDTSSICEDSFDGRSLSKLNLCEDGPCHKRRASICCTQLGSLSALKHAVLGLYLLVFLILVGIFILAGPPGPKGDQGDEGKEGRPGIPGLPGLRGLPGERGTPGLPGPKGDDGKLGATGPMGMRGFKGDRGPKGEKGEKGDRAGDASGVEAPMMIRLVNGSGPHEGRVEVYHDRRWGTVCDDGWDKKDGDVVCRMLGFRGVEEVYRTARFGQGTGRIWMDDVACKGTEETIFRCSFSKWGVTNCGHAEDASVTCNRH

SEQ ID NO: 13785 - protein, 357 aa, Artificial Sequence; identical to SEQ ID NO: 13782
  Description of Artificial Sequence: Synthetic coding sequence

SEQ ID NO: 13786 - protein, 400 aa, Artificial Sequence
  Description of Artificial Sequence: Synthetic coding sequence
MENKAMYLHTVSDCDTSSICEDSFDGRSLSKLNLCEDGPCHKRRASICCTQLGSLSALKHAVLGLYLLVFLILVGIFILAVSRPRSSPDDLKALTRNVNRLNESFRDLQLRLLQAPLQADLTEQVWKVQDALQNQSDSLLALAGAVQRLEGALWGLQAQAVQTEQAVALLRDRTGQQSDTAQLELYQLQVESNSSQLLLRRHAGLLDGLARRVGILGEELADVGGVLRGLNHSLSYDVALHRTRLQDLRVLVSNASEDTRRLRLAHVGMELQLKQELAMLNAVTEDLRLKDWEHSIALRNISLAKGPPGPKGDQGDEGKEGRPGIPGLPGLRGLPGERGTPGLPGPKGDDGKLGATGPMGMRGFKGDRGPKGEKGEKGDRAGDASKDILLGPWDMVLAQG

SEQ ID NO: 13787 - protein, 333 aa, Artificial Sequence
  Description of Artificial Sequence: Synthetic coding sequence
MVHGNITPENIILNKSGAWKIMGFDFCVSSTNPSEQEPKFPCKEWDPNLPSLCLPNPEYLAPEYILSVSCETASDMYSLGTVMYAVFNKGKPIFEVNKQDIYKSFSRQLDQLSRLGSSSLTNIPEEVREHVKLLLNVTPTVRPDADQMTKIPFFDDVGAVTLQYFDTLFQRDNLQKSQFFKGLPKVLPKLPKRVIVQRILPCLTSEFVNPDMVPFVLPNVLLIAEECTKEEYVKLILPELGPVFKQQEPIQILLIFLQKMDLLLTKTPPDEIKNSVLPMVYRALEAPSIQIQELCLNIIPTFANLIDYPSMKNALIPRIKNACYKHLPLRFQQ

SEQ ID NO: 13788 - protein, 929 aa, Artificial Sequence
  Description of Artificial Sequence: Synthetic coding sequence
MESMLNKLKSTVTKVTADVTSAVMGNPVTREFDVGRHIASGGNGLAWKIFNGTKKSTKQEVAVFVFDKKLIDKYQKFEKDQIIDSLKRGVQQLTRLRHPRLLTVQHPLEESRDCLAFCTEPVFASLANVLGNWENLPSPISPDIKDYKLYDVETKYGLLQVSEGLSFLHSSVKMVHGNITPENIILNKSGAWKIMGFDFCVSSTNPSEQEPKFPCKEWDPNLPSLCLPNPEYLAPEYILSVSCETASDMYSLGTVMYAVFNKGKPIFEVNKQDIYKSFSRQLDQLSRLGSSSLTNIPEEVREHVKLLLNVTPTVRPDADQMTKIPFFDDVGAVTLQYFDTLFQRDNLQKSQFFKGLPKVLPKLPKRVIVQRILPCLTSEFVNPDMVPFVLPNVLLIAEECTKEEYVKLILPELGPVFKQQEPIQILLIFLQKMDLLLTKTPPDEIKNSVLPMVYRALEAPSIQIQELCLNIIPTFANLIDYPSMKNALIPRIKNACLQTSSLAVRVNSLVCLGKILEYLDKWFVLDDILPFLQQIPSKEPAVLMGILGIYKCTFTHKKLGITKEQLAGKVLPHLIPLSIENNLNLNQFNSFISVIKEMLNRLESEHKTKLEQLHIMQEQQKSLDIGNQMNVSEEMKVTNIGNQQIDKVFNNIGADLLTGSESENKEDGLQNKHKRASLTLEEKQKLAKEQEQAQKLKSQQPLKPQVHTPVATVKQTKDLTDTLMDNMSSLTSLSVSTPKSSASSTFTSVPSMGIGMMFSTPTDNTKRNLTNGLNANMGFQTSGFNMPVNTNQNFYSSPSTVGVTKMTLGTPPTLPNFNALSVPPAGAKQTQQRPTDMSALNNLFGPQKPKVSMNQLSQQKPNQWLNQFVPPQGSPTMGSSVMGTQMNVIGQSAFGMQGNPFFNPQNFAQPPTTMTNSSSASNDLKDLFG

SEQ ID NO: 13789 - protein, 681 aa, Artificial Sequence
  Description of Artificial Sequence: Synthetic coding sequence
MESMLNKLKSTVTKVTADVTSAVMGNPVTREFDVGRHIASGGNGLAWKIFNGTKKSTKQEVAVFVFDKKLIDKYQKFEKDQIIDSLKRGVQQLTRLRHPRLLTVQHPLEESRDCLAFCTEPVFASLANVLGNWENLPSPISPDIKDYKLYDVETKYGLLQVSEGLSFLHSSVKMVHGNITPENIILNKSGAWKIMGFDFCVSSTNPSEQEPKFPCKEWDPNLPSLCLPNPEYLAPEYILSVSCETASDMYSLGTVMYAVFNKGKPIFEVNKQDIYKSFSRQLDQLSRLGSSSLTNIPEEVREHVKLLLNVTPTVRPDADQMTKIPFFDDVGAVTLQYFDTLFQRDNLQKSQFFKGLPKVLPKLPKRVIVQRILPCLTSEFVNPDMVPFVLPNVLLIAEECTKEEYVKLILPELGPVFKQQEPIQILLIFLQKMDLLLTKTPPDEIKNSVLPMVYRALEAPSIQIQELCLNIIPTFANLIDYPSMKNALIPRIKNACLQTSSLAVRVNSLVCLGKILEYLDKWFVLDDILPFLQQIPSKEPAVLMGILGIYKCTFTHKKLGITKEQLAGKVLPHLIPLSIENNLNLNQFNSFISVIKEMLNRLESEHKTKLEQLHIMQEQQKSLDIGNQMNVSEEMKVTNIGNQQIDKVFNNIGADLLTGSESENKEDGLQNKHKRASLTLE

SEQ ID NO: 13790 - protein, 550 aa, Artificial Sequence
  Description of Artificial Sequence: Synthetic coding sequence
MPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 13791 - protein, 583 aa, Artificial Sequence
  Description of Artificial Sequence: Synthetic coding sequence
MCLILKTAQENQYGRLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 13792 - protein, 642 aa, Artificial Sequence
  Description of Artificial Sequence: Synthetic coding sequence
MAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 13793 - protein, 457 aa, Artificial Sequence
  Description of Artificial Sequence: Synthetic coding sequence
METVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 13794 - protein, 575 aa, Artificial Sequence
  Description of Artificial Sequence: Synthetic coding sequence
MGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 13795 - protein, 179 aa, Artificial Sequence
  Description of Artificial Sequence: Synthetic coding sequence
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFVPYIGIVTILMNDYPKFKYAVLFLLGLFVLVHRE

SEQ ID NO: 13796 - protein, 153 aa, Artificial Sequence
  Description of Artificial Sequence: Synthetic coding sequence
MIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFVPYIGIVTILMNDYPKFKYAVLFLLGLFVLVHRE

SEQ ID NO: 13797 - protein, 192 aa, Artificial Sequence
  Description of Artificial Sequence: Synthetic coding sequence
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARGFLPYVGMVTIIMNDYPKFKYALLAVMGAYVLLKRES

SEQ ID NO: 13798 - protein, 156 aa, Artificial Sequence
  Description of Artificial Sequence: Synthetic coding sequence
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARG

SEQ ID NO: 13799 - protein, 192 aa, Artificial Sequence; identical to SEQ ID NO: 13797
  Description of Artificial Sequence: Synthetic coding sequence

SEQ ID NO: 13800 - protein, 696 aa, Artificial Sequence
  Description of Artificial Sequence: Synthetic coding sequence
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTEDFGGSLTYDHMDWLNKRLVFEKFTKESTSLLDELALINNGSDKGNQQEKERSVDLNFLPSVDPETVLQTGHELLSELQQRRFNGSDGGVSWSPMDDELLAQPQVMKLLDSLREQYTRYQEVCRQRSKRTQLEEIQQKVMQVVNWLEGPGSEQLRAQWGIGDSIRASQALQQKHEEIESQHSEWFAVYVELNQQIAALLNAGDEEDLVELKSLQQQLSDVCYRQASQLEFRQNLLQAALEFHGVAQDLSQQLDGLLGMLCVDVAPADGASIQQTLKLLEEKLKSVDVGLQGLREKGQGLLDQISNQASWAYGKDVTIENKENVDHIQGVMEDMQLRKQRCEDMVDVRRLKMLQMVQLFKCEEDAAQAVEWLSELLDALLKTHIRLGDDAQETKVLLEKHRKFVDVAQSTYDYGRQLLQATVVLCQSLRCTSRSSGDTLPRLNRVWKQFTIASEERVHRLEMAIAFHSNAEKILQDCPEEPEAINDEEQFDEIEAVGKSLLDRLTVPVVYPDGTEQYFGSPSDMASTAENIRDRMKLVNLKRQQLRHPEMVTTES

SEQ ID NO: 13801 - protein, 143 aa, Artificial Sequence
  Description of Artificial Sequence: Synthetic coding sequence
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTE

SEQ ID NO: 13802 - protein, 146 aa, Artificial Sequence
  Description of Artificial Sequence: Synthetic coding sequence
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTEDFG

SEQ ID NO: 13803 - protein, 719 aa, Artificial Sequence
  Description of Artificial Sequence: Synthetic coding sequence
MVQKYQSPVRVYKYPFELIMAAYERRFPTCPLIPMFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITTSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISRWRFC

SEQ ID NO: 13804 - protein, 715 aa, Artificial Sequence
  Description of Artificial Sequence: Synthetic coding sequence
MVQKYQSPVRVYKYPFELIMAAYERRFPTCPLIPMFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITTSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISR

SEQ ID NO: 13805 - protein, 715 aa, Artificial Sequence; identical to SEQ ID NO: 13804
  Description of Artificial Sequence: Synthetic coding sequence

SEQ ID NO: 13806 - protein, 681 aa, Artificial Sequence
  Description of Artificial Sequence: Synthetic coding sequence
MFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITTSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISR

SEQ ID NO: 13807 - protein, 715 aa, Artificial Sequence; identical to SEQ ID NO: 13804
  Description of Artificial Sequence: Synthetic coding sequence

SEQ ID NO: 13808 - protein, 719 aa, Artificial Sequence; identical to SEQ ID NO: 13803
  Description of Artificial Sequence: Synthetic coding sequence

SEQ ID NO: 13809 - protein, 696 aa, Artificial Sequence
  Description of Artificial Sequence: Synthetic coding sequence
MVQRYQSPVRVYKYPFELVMAAYEKRFPTCPQIPVFLGSEVLRESRSPDGAVHVVERSCRLRVDAPRLLRKIAGVEHVVFVQTNILNWKERTLLIEAHNETFANRVVVNEHCSYTVHPENEDWTCFEQSASLDIRSFFGFENALEKIAMKQYTANVKRGKEVIEHYLNELISQGTSHIPRWTPAPVREEDARNQAGPRDPSSLEAHGPRSTLGPALEAVSMDGDKLDADYIERCLGHLTPMQESCLIQLRHWLQETHKGKIPKDEHILRFLRAHDFHLDKAREMLRQSLSWRKQHQVDLLLQTWQPPALLEEFYAGGWHYQDIDGRPLYILRLGQMDTKGLMKAVGEEALLRHVLSVNEEGQKRCEGSTRQLGRPISSWTCLLDLEGLNMRHLWRPGVKALLRMIEVVEDNYPETLGRLLIVRAPRVFPVLWTLISPFINENTRRKFLIYSGSNYQGPGGLVDYLDREVIPDFLGGESVCNVPEGGLVPKSLYMTEEEQEHTDQLWQWSETYHSASVLRGAPHEVAVEILEGESVITWDFDILRGDVVFSLYHTKQAPRLGAREPGTRASGQLIDKGWVLGRDYSRVEAPLVCREGESIQGSHVTRWPGVYLLQWQMHSPPSSVACSLPGVDDVLTALHSPGPKCKLLYYCEVLASEDFRGSMSSLESCTSGFSQLSAATSSSSSGQSHSSSLVSR

SEQ ID NO: 13810 - protein, 303 aa, Artificial Sequence
  Description of Artificial Sequence: Synthetic coding sequence
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQCYLYLFYSPARTMKVVLMLLFICLGNMYLHGLRNLWQILFHIGVAFLSSYQILTRQLQEKQSDCGV

SEQ ID NO: 13811 - protein, 250 aa, Artificial Sequence
  Description of Artificial Sequence: Synthetic coding sequence
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQDPRSWFCWLDQTS

SEQ ID NO: 13812 - protein, 250 aa, Artificial Sequence; identical to SEQ ID NO: 13811
  Description of Artificial Sequence: Synthetic coding sequence

SEQ ID NO: 13813 - protein, 228 aa, Artificial Sequence
  Description of Artificial Sequence: Synthetic coding sequence
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQDPRSWFCWLDQTS

SEQ ID NO: 13814 - protein, 180 aa, Artificial Sequence
  Description of Artificial Sequence: Synthetic coding sequence
MAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQDPRSWFCWLDQTS

SEQ ID NO: 13815 - protein, 613 aa, Artificial Sequence
  Description of Artificial Sequence: Synthetic coding sequence
MSQPGIPASGGAPASLQAQNGAALASGSPYTNGPVQNALLSSQESVSQGYNFQLPGSYPHPIPAKTLNPVSGQSNYGGSQGSGQTLNRPPVASNPVTPSLHSGPAPRMPLPASQNPATTPMPSSSFLPEANLPPPLNWQYNYPSTASQTNHCPRASSQPTVSGNTSLTTNHQYVSSGYPSLQNSFIKSGPSVPPLVNPPLPTTFQPGAPHGPPPAGGPPPVRALTPLTSSYRDVPQPLFNSAVNQEGITSNTNNGSMVVHSSYDEIEGGGLLATPQLTNKNPKMSRSVGYSYPSLPPGYQNTTPPGATGVPPSSLNYPSGPQAFTQTPLGANHLTTSMSGLSLQPEGLRVVNLLQERNMLPSTPLKPPVPNLHEDIQKLNCNPELFRCTLTSIPQTQALLNKAKLPLGLLLHPFKDLVQLPVVTSSTIVRCRSCRTYINPFVSFLDQRRWKCNLCYRVNDVPEEFLYNPLTRVYGEPHRRPEVQNATIEFMAPSEYMLRPPQPPVYLFVFDVSHNAVETGYLNSVCQSLLDNLDLLPGNTRTKIGFITFDSTIHFYGLQESLSQPQMLIVSDIEDVFIPMPENLLVNLNESKESVIGVSSEETLITCLEIAMR

SEQ ID NO: 13816 - protein, 1093 aa, Artificial Sequence
  Description of Artificial Sequence: Synthetic coding sequence
MSQPGIPASGGAPASLQAQNGAALASGSPYTNGPVQNALLSSQESVSQGYNFQLPGSYPHPIPAKTLNPVSGQSNYGGSQGSGQTLNRPPVASNPVTPSLHSGPAPRMPLPASQNPATTPMPSSSFLPEANLPPPLNWQYNYPSTASQTNHCPRASSQPTVSGNTSLTTNHQYVSSGYPSLQNSFIKSGPSVPPLVNPPLPTTFQPGAPHGPPPAGGPPPVRALTPLTSSYRDVPQPLFNSAVNQEGITSNTNNGSMVVHSSYDEIEGGGLLATPQLTNKNPKMSRSVGYSYPSLPPGYQNTTPPGATGVPPSSLNYPSGPQAFTQTPLGANHLTTSMSGLSLQPEGLRVVNLLQERNMLPSTPLKPPVPNLHEDIQKLNCNPELFRCTLTSIPQTQALLNKAKLPLGLLLHPFKDLVQLPVVTSSTIVRCRSCRTYINPFVSFLDQRRWKCNLCYRVNDVPEEFLYNPLTRVYGEPHRRPEVQNATIEFMAPSEYMLRPPQPPVYLFVFDVSHNAVETGYLNSVCQSLLDNLDLLPGNTRTKIGFITFDSTIHFYGLQESLSQPQMLIVSDIEDVFIPMPENLLVNLNESKELVQDLLKTLPQMFTKTLETQSALGPALQAAFKLMSPTGGRMSVFQTQLPTLGVGALKPREEPNHRSSAKDIHMTPSTDFYKKLALDCSGQQVAVDLFLLSGQYSDLASLGCISRYSAGSVYYYPSYHHQHNPVQVQKLQKELQRYLTRKIGFEAVMRIRCTKGLSIHTFHGNFFVRSTDLLSLPNVNPDAGYAVQMSVEESLTDTQLVSFQSALLYTSSKGERRIRVHTLCLPVVSTLNDVFLGADVQAISGLLANMAVDRSMTASLSDARDALVNAVIDSLSAYRSSVLSNQQPGLMVPFSLRLFPLFVLALLKQKSFQTGTNARLDERIFAMCQVKNQPLVYLMLTTHPSLYRVDNLSDEGALNISDRTIPQPPILQLSVEKLSRDGAFLMDAGSVLMLWVGKNCTQNFLSQVLGVQNYASIPQPMTDLPELDTPESARIIAFISWLREQRPFFPILYVIRDESPMKANFLQNMIEDRTESALSYYEFLLHIQQQVNK

SEQ ID NO: 13817 - protein, 1268 aa, Artificial Sequence
  Description of Artificial Sequence: Synthetic coding sequence
MSAPAGSSHPAASARIPPKFGGAAVSGAAAPAGPGAGPAPHQQNGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAISHPSPLPPLPSQQHHQQQSLSGYSTLTWSSPGLPSTQDNLIRNHTGSLAVANNNPTITVADSLSCPVMQNVQPPKSSPVVSTVLSGSSGSSSTRTPPTANHPVEPVTSVTQPSELLQQKGVQYGEYVNNQASSAPTPLSSTSDDEEEEEEDEEAGVDSSSTTSSASPMPNSYDALEGGSYPDMLSSSASSPAPDPAPEPDPASAPAPASAPAPVVPQPSKMAKPFGYGYPTLQPGYQNATAPLISGVQPSNPVYSGFQQYPQQYPGVNQLSSSIGGLSLQSSPQPESLRPVNLTQERNILPMTPVWAPVPNLNADLKKLNCSPDSFRCTLTNIPQTQALLNKAKLPLGLLLHPFRDLTQLPVITSNTIVRCRSCRTYINPFVSFIDQRRWKCNLCYRVNDVPEEFMYNPLTRSYGEPHKRPEVQNSTVEFIASSDYMLRPPQPAVYLFVLDVSHNAVEAGYLTILCQSLLENLDKLPGDSRTRIGFMTFDSTIHFYNLQEGLSQPQMLIVSDIDDVFLPTPDSLLVNLYESKELIKDLLNALPNMFTNTRETHSALGPALQAAFKLMSPTGGRVSVFQTQLPSLGAGLLQSREDPNQRSSTKVVQHLGPATDFYKKLALDCSGQQTAVDLFLLSSQYSDLASLACMSKYSAGCIYYYPSFHYTHNPSQAEKLQKDLKRYLTRKIGFEAVMRIRCTKGLSMHTFHGNFFVRSTDLLSLANINPDAGFAVQLSIEESLTDTSLVCFQTALLYTSSKGERRIRVHTLCLPVVSSLADVYAGVDVQAAICLLANMAVDRSVSSSLSDARDALVNAVVDSLSAYGSTVSNLQHSALMAPSSLKLFPLYVLALLKQKAFRTGTSTRLDDRVYAMCQIKSQPLVHLMKMIHPNLYRIDRLTDEGAVHVNDRIVPQPPLQKLSAEKLTREGAFLMDCGSVFYIWVGKGCDNNFIEDVLGYTNFASIPQKMTHLPELDTLSSERARSFITWLRDSRPLSPILHIVKDESPAKAEFFQHLIEDRTEAAFSYYEFLLHVQQQICK

SEQ ID NO: 13818 - protein, 1233 aa, Artificial Sequence
  Description of Artificial Sequence: Synthetic coding sequence
MSAPAGSSHPAASARIPPKFGGAAVSGAAAPAGPGAGPAPHQQNGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAISHPSPLPPLPSQQHHQQQSLSGYSTLTWSSPGLPSTQDNLIRNHTGSLAVANNNPTITVADSLSCPVMQNVQPPKSSPVVSTVLSGSSGSSSTRTPPTANHPVEPVTSVTQPSELLQQKGVDSSSTTSSASPMPNSYDALEGGSYPDMLSSSASSPAPDPAPEPDPASAPAPASAPAPVVPQPSKMAKPFGYGYPTLQPGYQNATAPLISGVQPSNPVYSGFQQYPQQYPGVNQLSSSIGGLSLQSSPQPESLRPVNLTQERNILPMTPVWAPVPNLNADLKKLNCSPDSFRCTLTNIPQTQALLNKAKLPLGLLLHPFRDLTQLPVITSNTIVRCRSCRTYINPFVSFIDQRRWKCNLCYRVNDVPEEFMYNPLTRSYGEPHKRPEVQNSTVEFIASSDYMLRPPQPAVYLFVLDVSHNAVEAGYLTILCQSLLENLDKLPGDSRTRIGFMTFDSTIHFYNLQEGLSQPQMLIVSDIDDVFLPTPDSLLVNLYESKELIKDLLNALPNMFTNTRETHSALGPALQAAFKLMSPTGGRVSVFQTQLPSLGAGLLQSREDPNQRSSTKVVQHLGPATDFYKKLALDCSGQQTAVDLFLLSSQYSDLASLACMSKYSAGCIYYYPSFHYTHNPSQAEKLQKDLKRYLTRKIGFEAVMRIRCTKGLSMHTFHGNFFVRSTDLLSLANINPDAGFAVQLSIEESLTDTSLVCFQTALLYTSSKGERRIRVHTLCLPVVSSLADVYAGVDVQAAICLLANMAVDRSVSSSLSDARDALVNAVVDSLSAYGSTVSNLQHSALMAPSSLKLFPLYVLALLKQKAFRTGTSTRLDDRVYAMCQIKSQPLVHLMKMIHPNLYRIDRLTDEGAVHVNDRIVPQPPLQKLSAEKLTREGAFLMDCGSVFYIWVGKGCDNNFIEDVLGYTNFASIPQKMTHLPELDTLSSERARSFITWLRDSRPLSPILHIVKDESPAKAEFFQHLIEDRTEAAFSYYEFLLHVQQQICK

SEQ ID NO: 13819 - protein, 1298 aa, Artificial Sequence
  Description of Artificial Sequence: Synthetic coding sequence
MSAPAGSSHPAASARIPPKFGGAAVSGAAAPAGPGAGPAPHQQNETGFHHVAQASLELLDPSNLPASASQIAGSTGPAQNQMQVPSGYGLHHQNYIAPSGHYSQGPGKMTSLPLDTQCGDYYSALYTVPTQNVTPNTVNQQPGAQQLYSRGPPAPHIVGSTLGSFQGAASSASHLHTSASQPYSSFVNHYNSPAMYSASSSVASQGFPSTCGHYAMSTVSNAAYPSVSYPSLPAGDTYGQMFTSQNAPTVRPVKDNSFSGQNTAISHPSPLPPLPSQQHHQQQSLSGYSTLTWSSPGLPSTQDNLIRNHTGSLAVANNNPTITVADSLSCPVMQNVQPPKSSPVVSTVLSGSSGSSSTRTPPTANHPVEPVTSVTQPSELLQQKGVQYGEYVNNQASSAPTPLSSTSDDEEEEEEDEEAGVDSSSTTSSASPMPNSYDALEGGSYPDMLSSSASSPAPDPAPEPDPASAPAPASAPAPVVPQPSKMAKPFGYGYPTLQPGYQNATAPLISGVQPSNPVYSGFQQYPQYPGVNQLSSSIGGLSLQSSPQPESLRPVNLTQERNILPMTPVWAPVPNLNADLKKLNCSPDSFRCTLTNIPQTQALLNKAKLPLGLLLHPFRDLTQLPVITSNTIVRCRSCRTYINPFVSFIDQRRWKCNLCYRVNDVPEEFMYNPLTRSYGEPHKRPEVQNSTVEFIASSDYMLRPPQPAVYLFVLDVSHNAVEAGYLTILCQSLLENLDKLPGDSRTRIGFMTFDSTIHFYNLQEGLSQPQMLIVSDIDDVFLPTPDSLLVNLYESKELIKDLLNALPNMFTNTRETHSALGPALQAAFKLMSPTGGRVSVFQTQLPSLGAGLLQSREDPNQRSSTKVVQHLGPATDFYKKLALDCSGQQTAVDLFLLSSQYSDLASLACMSKYSAGCIYYYPSFHYTHNPSQAEKLQKDLKRYLTRKIGFEAVMRIRCTKGLSMHTFHGNFFVRSTDLLSLANINPDAGFAVQLSIEESLTDTSLVCFQTALLYTSSKGERRIRVHTLCLPVVSSLADVYAGVDVQAAICLLANMAVDRSVSSSLSDARDALVNAVVDSLSAYGSTVSNLQHSALMAPSSLKLFPLYVLALLKQKAFRTGTSTRLDDRVYAMCQIKSQPLVHLMKMIHPNLYRIDRLTDEGAVHVNDRIVPQPPLQKLSAEKLTREGAFLMDCGSVFYIWVGKGCDNNFIEDVLGYTNFASIPQKMTHLPELDTLSSERARSFITWLRDSRPLSPILHIVKDESPAKAEFFQHLIEDRTEAAFSYYEFLLHVQQQICK

SEQ ID NO: 13820 - protein, 1094 aa, Artificial Sequence
  Description of Artificial Sequence: Synthetic coding sequence
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 13821 - protein, 1094 aa, Artificial Sequence; identical to SEQ ID NO: 13820
  Description of Artificial Sequence: Synthetic coding sequence

SEQ ID NO: 13822 - protein, 975 aa, Artificial Sequence
  Description of Artificial Sequence: Synthetic coding sequence
MQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPQLSELPPQQKTRHRIDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 13823 - protein, 342 aa, Artificial Sequence
  Description of Artificial Sequence: Synthetic coding sequence
MRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 13824 - protein, 342 aa, Artificial Sequence; identical to SEQ ID NO: 13823
  Description of Artificial Sequence: Synthetic coding sequence

SEQ ID NO: 13825 - protein, 1032 aa, Artificial Sequence
  Description of Artificial Sequence: Synthetic coding sequence
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQPGSQVLPPPPTTLNGPGASPLPLPMYRPDGLSGPPPPNAQYQPPPLPGQTLGAGYPPQQANSGPQMAGAQLSYPGGFPGGPAQMAGPPQPQKKLDPDSIPSPIQVIENDRASRGGQVYATNTRGQIPPLVTTDCMIQDQGNASPRFIRCTTYCFPCTSDMAKQAQIPLAAVIKPFATIPSNESPLYLVNHGESGPVRCNRCKAYMCPFMQFIEGGRRYQCGFCNCVNDVPPFYFQHLDHIGRRLDHYEKPELSLGSYEYVATLDYCRKSKPPNPPAFIFMIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQLILPDSMKVLPVYMNCLLKNCVLLSRPEISTDERAYQRQLVMTMGVADSQLFFYPQLLPIHTLDVKSTMLPAAVRCSESRLSEEGIFLLANGLHMFLWLGVSSPPELIQGIFNVPSFAHINTDMTLLPEVGNPYSQQLRMIMGIIQQKRPYSMKLTIVKQREQPEMVFRQFLVEDKGLYGGSSYVDFLCCVHKEICQLLN

SEQ ID NO: 13826 - protein, 1033 aa, Artificial Sequence
  Description of Artificial Sequence: Synthetic coding sequence
MSQQGYVATPPYSQPQPGIGLSPPHYGHYGDPSHTASPTGMMKPAGPLGATATRGMLPPGPPPPGPHQFGQNGAHATGHPPQRFPGPPPVNNVASSHAPYQPSAQSSYPGPISTSSVTQLGSQLSAMQINSYGSGMAPPSQGPPGPLSATSLQTPPRPPQPSILQPGSQVLPPPPTTLNGPGASPLPLPMYRPDGLSGPPPPNAQYQPPPLPGQTLGAGYPPQQAANSGPQMAGAQLSYPGGFPGGPAQMAGPPQPQKKLDPDSIPSPIQVIENDRASRGGQVYATNTRGQIPPLVTTDCMIQDQGNASPRFIRCTTYCFPCTSDMAKQAQIPLAAVIKPFATIPSNESPLYLVNHGESGPVRCNRCKAYMCPFMQFIEGGRRYQCGFCNCVNDVPPFYFQHLDHIGRRLDHYEKPELSLGSYEYVATLDYCRKSKPPNPPAFIFMIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQLILPDSMKVLPVYMNCLLKNCVLLSRPEISTDERAYQRQLVMTMGVADSQLFFYPQLLPIHTLDVKSTMLPAAVRCSESRLSEEGIFLLANGLHMFLWLGVSSPPELIQGIFNVPSFAHINTDMTLLPEVGNPYSQQLRMIMGIIQQKRPYSMKLTIVKQREQPEMVFRQFLVEDKGLYGGSSYVDFLCCVHKEICQLLN

SEQ ID NO: 13827 - protein, 393 aa, Artificial Sequence
  Description of Artificial Sequence: Synthetic coding sequence
MIDVSYSNIKNGLVKLICEELKTMLEKIPKEEQEETSAIRVGFITYNKVLHFFNVKSNLAQPQMMVVTDVGEVFVPLLDGFLVNYQESQSVIHNLLDQIPDMFADSNENETVFAPVIQAGMEALKAADCPGKLFIFHSSLPTAEAPGKLKNRDDKKLVNTDKEKILFQPQTNVYDSLAKDCVAHGCSVTLFLFPSQYVDVASLGLVPQLTGGTLYKYNNFQMHLDRQQFLNDLRNDIEKKIGFDAIMRVRTSTGFRATDFFGGILMNNTTDVEMAAIDCDKAVTVEFKHDDKLSEDSGALIQCAVLYTTISGQRRLRIHNLGLNCSSQLADLYKSCETDALINFFAKSAFKAVLHQPLKVIREILVNQTAHMLACYRKNCASPSAASQFTCEK

SEQ ID NO: 13828 - protein, 393 aa, Artificial Sequence; identical to SEQ ID NO: 13827
  Description of Artificial Sequence: Synthetic coding sequence

SEQ ID NO: 13829 - protein, 969 aa, Artificial Sequence
  Description of Artificial Sequence: Synthetic coding sequence
MVKLVLLSIVLLKVTVPKLSNDLLQLDFMPIHRGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHVRIAPTVTTWSNKTPTALPSHPPAASPSDTQGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 13830 - protein, 1106 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQRPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 13831 - protein, 1181 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 13832 - protein, 1181 aa, Artificial Sequence; identical to SEQ ID NO: 13831
  Description of Artificial Sequence: Synthetic coding sequence

SEQ ID NO: 13833 - protein, 1220 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 13834 - protein, 1220 aa, Artificial Sequence; identical to SEQ ID NO: 13833
  Description of Artificial Sequence: Synthetic coding sequence

SEQ ID NO: 13835 - protein, 1233 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGTLPAASELPASQRTENQSIQDQAPMLEGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 13836 - protein, 1220 aa, Artificial Sequence; identical to SEQ ID NO: 13833
  Description of Artificial Sequence: Synthetic coding sequence

SEQ ID NO: 13837 - protein, 1067 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQRPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 13838 - protein, 81 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSSHRYHKLIWGPYKMDS

SEQ ID NO: 13839 - protein, 66 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSS

SEQ ID NO: 13840 - protein, 1166 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 13841 - protein, 27 aa, Artificial Sequence
  Description of Artificial Sequence: Synthetic coding sequence
MKLKEVDRTAMQAWSPAQNHPIYLATG

SEQ ID NO: 13842 - protein, 1205 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 13843 - protein, 1106 aa, Artificial Sequence; identical to SEQ ID NO: 13830
  Description of Artificial Sequence: Synthetic coding sequence

SEQ ID NO: 13844 - protein, 165 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKT

SEQ ID NO: 13845 - protein, 166 aa, Artificial Sequence
  Description of Artificial Sequence: Synthetic coding sequence
MKLKEVDRTAMQAWSPAQNHPIYLATGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQ

SEQ ID NO: 13846 - protein, 1200 aa, Artificial Sequence
  Description of Artificial Sequence: Synthetic coding sequence
MLGESDERCTNAGSGCRRSSPGTSAQQLDATFSTNASLEIFELDLSDPSLDMKSCATFSSSHRYHKLIWGPYKMDSKGDVSGVLIAGGENGNIILYDPSKIIAGDKEVVIAQNDKHTGPVRALDVNIFQTNLVASGANESEIYIWDLNNFATPMTPGAKTQPPEDISCIAWNRQVQHILASASPSGRATVWDLRKNEPIIKVSDHSNRMHCSGLAWHPDVATQMVLASEDDRLPVIQMWDLRFASSPLRVLENHARGILAIAWSMADPELLLSCGKDAKILCSNPNTGEVLYELPTNTQWCFDIQWCPRNPAVLSAASFDGRISVYSIMGGSTDGLRQKQVDKLSSSFGNLDPFGTGQPLPPLQIPQQTAQHSIVLPLKKPPKWIRRPVGASFSFGGKLVTFENVRMPSHQGAEQQQQQHHVFISQVVTEKEFLSRSDQLQQAVQSQGFINYCQKKIDASQTEFEKNVWSFLKVNFEDDSRGKYLELLGYRKEDLGKKIALALNKVDGANVALKDSDQVAQSDGEESPAAEEQLLGEHIKEEKEESEFLPSSGGTFNISVSGDIDGLITQALLTGNFESAVDLCLHDNRMADAIILAIAGGQELLARTQKKYFAKSQSKITRLITAVVMKNWKEIVESCDLKNWREALAAVLTYAKPDEFSALCDLLGTRLENEGDSLLQTQACLCYICAGNVEKLVACWTKAQDGSHPLSLQDLIEKVVILRKAVQLTQAMDTSTVGVLLAAKMSQYANLLAAQGSIAAALAFLPDNTNQPNIMQLRDRLCRAQGEPVAGHESPKIPYEKQQLPKGRPGPVAGHHQMPRVQTQQYYPHGENPPPPGFIMHGNVNPNAAGQLPTSPGHMHTQVPPYPQPQPYQPAQPYPFGTGGSAMYRPQQPVAPPTSNAYPNTPYISSASSYTGQSQLYAAQHQASSPTSSPATSFPPPPSSGASFQHGGPGAPPSSSAYALPPGTTGPQNGWNDPPALNRVPKKKKMPENFMPPVPITSPIMNPLGDPQSQMLQQQPSAPVPLSSQSSFPQPHLPGGQPFHGVQQPLGQTGMPPSFSKPNIEGAPGAPIGNTFQHVQSLPTKKITKKPIPDEHLILKTTFEDLIQRCLSSATDPQTKRKLDDASKRLEFLYDKLREQTLSPTITSGLHNIARSIETRNYSEGLTMHTHIVSTSNFSETSAFMPVLKVVLTQANKLGV

SEQ ID NO: 13847 - protein, 476 aa, Artificial Sequence
  Description of Artificial Sequence: Synthetic coding sequence
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 13848 - protein, 356 aa, Artificial Sequence
  Description of Artificial Sequence: Synthetic coding sequence
MIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 13849 - protein, 482 aa, Artificial Sequence
  Description of Artificial Sequence: Synthetic coding sequence
MTQTARVLVKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 13850 - protein, 476 aa, Artificial Sequence
  Description of Artificial Sequence: Synthetic coding sequence
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 13851 - protein, 437 aa, Artificial Sequence
  Description of Artificial Sequence: Synthetic coding sequence
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRPKVKLRRWKGEGRHFTKRILFY

SEQ ID NO: 13852 - protein, 168 aa, Artificial Sequence
  Description of Artificial Sequence: Synthetic coding sequence
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQALLTLKICGYTEEL

SEQ ID NO: 13853 - protein, 410 aa, Artificial Sequence
  Description of Artificial Sequence: Synthetic coding sequence
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQDVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 13854 - protein, 454 aa, Artificial Sequence
  Description of Artificial Sequence: Synthetic coding sequence
MGIKFLEVIKPFCAVLPEIQKPERKIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 13855 - protein, 159 aa, Artificial Sequence
  Description of Artificial Sequence: Synthetic coding sequence
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQDQHSP

SEQ ID NO: 13856 - protein, 145 aa, Artificial Sequence
  Description of Artificial Sequence: Synthetic coding sequence
  MOD_RES (1)..(1): Any amino acid
XSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQGFRVDLPIKSARYRGQYSSYPIKLFYTSNIPIILQSALVSNLYVI

SEQ ID NO: 13857 - protein, 228 aa, Artificial Sequence
  Description of Artificial Sequence: Synthetic coding sequence
  MOD_RES (1)..(1): Any amino acid
XGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQVAKQLKEQQMVMRGHRDTSMVHELNRYIPTAAAFGGLCIGALSVLADFLGAIGSGTGILLAVTIIYQYFEIFVKEQAEVGGMGALFF

SEQ ID NO: 13858 - protein, 210 aa, Artificial Sequence
  Description of Artificial Sequence: Synthetic coding sequence
KYNLFTKGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNRYIPTAAAFGGLCIGALSVLADFLGAIGSGTGILLAVTIIYQYFEIFV

SEQ ID NO: 13859 - protein, 189 aa, Artificial Sequence
  Description of Artificial Sequence: Synthetic coding sequence
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKRTEFEGAVIALFHLLATRTDKVRALREAFYRQNLPNLMNLIATVFVFAVVIYFQGFRVDLPIKSARYRGQYS

SEQ ID NO: 13860 - protein, 94 aa, Artificial Sequence
  Description of Artificial Sequence: Synthetic coding sequence
  MOD_RES (1)..(1): Any amino acid
XFREKVLWTAITLFIFLVCCQIPLFGIMSSDSADPFYWMRVILASNRGTLMELGISPIVTSGLIMQLLAGAKIIEVGDTPKDRALFNGAQKREH

SEQ ID NO: 13861 - protein, 418 aa, Artificial Sequence
  Description of Artificial Sequence: Synthetic coding sequence
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNSARA

SEQ ID NO: 13862 - protein, 96 aa, Artificial Sequence
  Description of Artificial Sequence: Synthetic coding sequence
MPGPTPSGTNVGSSGRSPSKAVAARAAGSTVRQRKNASCGTRSAGRTTSAGTGGMWRFYTEDSPGLKVGPVPVLVMSLLFIASVFMLHIWGKYTRS

SEQ ID NO: 13863 - protein, 68 aa, Artificial Sequence
  Description of Artificial Sequence: Synthetic coding sequence
MDQVMQFVEPSRQFVKDSIRLVKRCTKPDRKEFQKIAMATAIGFAIMGFIGFFVKLIHIPINNIIVGG

SEQ ID NO: 13864 - protein, 68 aa, Artificial Sequence; identical to SEQ ID NO: 13863
  Description of Artificial Sequence: Synthetic coding sequence

SEQ ID NO: 13865 - protein, 68 aa, Artificial Sequence; identical to SEQ ID NO: 13863
  Description of Artificial Sequence: Synthetic coding sequence

SEQ ID NO: 13866 - protein, 68 aa, Artificial Sequence; identical to SEQ ID NO: 13863
  Description of Artificial Sequence: Synthetic coding sequence

SEQ ID NO: 13867 - protein, 869 aa, Artificial Sequence
  Description of Artificial Sequence: Synthetic coding sequence
MAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 13868 - protein, 508 aa, Artificial Sequence
  Description of Artificial Sequence: Synthetic coding sequence
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVTAPPPPPPLQPHYHRVSV

SEQ ID NO: 13869 - protein, 994 aa, Artificial Sequence
  Description of Artificial Sequence: Synthetic coding sequence
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 13870 - protein, 993 aa, Artificial Sequence
  Description of Artificial Sequence: Synthetic coding sequence
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGETREYEVSI

SEQ ID NO: 13871 - protein, 910 aa, Artificial Sequence
  Description of Artificial Sequence: Synthetic coding sequence
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVTQTTDPSRQLEGGNLALAILLPLGLVIVLGSGVYIYYTKLQGKSLFGFSGSHSYSPITVESDFSNPLYEAGDTREYEVSI

SEQ ID NO: 13872 - protein, 809 aa, Artificial Sequence
  Description of Artificial Sequence: Synthetic coding sequence
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 13873 - protein, 853 aa, Artificial Sequence
  Description of Artificial Sequence: Synthetic coding sequence
MGTPRAQHPPPPQLLFLILLSCPWIQGLPLKEEEILPEPGSETPTVASEALAELLHGALLRRGPEMGYLPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 13874 - protein, 879 aa, Artificial Sequence
  Description of Artificial Sequence: Synthetic coding sequence
MGTPRAQHPPPPQLLFLILLSCPWIQGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVAYEELLDNRKLEVTQTTDPSRQLEGGNLALAILLPLGLVIVLGSGVYIYYTKLQGKSLFGFSGSHSYSPITVESDFSNPLYEAGDTREYEVSI

SEQ ID NO: 13875 - protein, 1097 aa, Artificial Sequence
  Description of Artificial Sequence: Synthetic coding sequence
MAPRPKKQPDKNPLHGRELNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 13876 - protein, 1132 aa, Artificial Sequence
  Description of Artificial Sequence: Synthetic coding sequence
MQRRGAGLGWPRQQQQQPPPLAVGPRAAAMVPSGGVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 13877 - protein, 979 aa, Artificial Sequence
  Description of Artificial Sequence: Synthetic coding sequence
MVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 13878 - protein, 75 aa, Artificial Sequence
  Description of Artificial Sequence: Synthetic coding sequence
MVYRDDYFIRHSISVSAVIVRAWITHKYSGRDWNVKWEENLLHAVAKNYTLLQTIPPFERPFKDHQVCLEWNMGY

SEQ ID NO: 13879 - protein, 62 aa, Artificial Sequence
  Description of Artificial Sequence: Synthetic coding sequence
MVYRDDYFIRHSISVSAVIVRAWITHKYSGRDWNVKWEENLLHAVAKNYTLLQTIPPFERPF

SEQ ID NO: 13880 - protein, 35 aa, Artificial Sequence
  Description of Artificial Sequence: Synthetic coding sequence
MVYRDDYFIRHSISVSAVIVRAWITHKYSGRDWNV

SEQ ID NO: 13881 - protein, 189 aa, Artificial Sequence
  Description of Artificial Sequence: Synthetic coding sequence
  MOD_RES (188)..(188): Selenocysteine
MERQEESLSARPALETEGLRFLHTTVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRPGRRGPSSGGCG

SEQ ID NO: 13882 - protein, 189 aa, Artificial Sequence; identical to SEQ ID NO: 13881
  Description of Artificial Sequence: Synthetic coding sequence
  MOD_RES (188)..(188): Selenocysteine

SEQ ID NO: 13883 - protein, 187 aa, Artificial Sequence
  Description of Artificial Sequence: Synthetic coding sequence
MERQEESLSARPALETEGLRFLHTTVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRPGRRGPSSGG

SEQ ID NO: 13884 - protein, 888 aa, Artificial Sequence
  Description of Artificial Sequence: Synthetic coding sequence
MQTPRASPPRPALLLLLLLLGGAHGLFPEEPPPLSVAPRDYLNHYPVFVGSGPGRLTPAEGADDLNIQRVLRVNRTLFIGDRDNLYRVELEPPTSTELRYQRKLTWRSNPSDINVCRMKGKQEGECRNFVKVLLLRDESTLFVCGSNAFNPVCANYSIDTLQPVGDNISGMARCPYDPKHANVALFSDGMLFTATVTDFLAIDAVIYRSLGDRPTLRTVKHDSKWFKEPYFVHAVEWGSHVYFFFREIAMEFNYLEKVVVSRVARVCKNDVGGSPRVLEKQWTSFLKARLNCSVPGDSHFYFNVLQAVTGVVSLGGRPVVLAVFSTPSNSIPGSAVCAFDLTQVAAVFEGRFREQKSPESIWTPVPEDQVPRPRPGCCAAPGMQYNASSALPDDILNFVKTHPLMDEAVPSLGHAPWILRTLMRHQLTRVAVDVGAGPWGNQTVVFLGSEAGTVLKFLVRPNASTSGTSGLSVFLEEFETYRPDRCGRPGGGETGQRLLSLELDAASGGLLAAFPRCVVRVPVARCQQYSGCMKNCIGSQDPYCGWAPDGSCIFLSPGTRAAFEQDVSGASTSGLGDCTGLLRASLSEDRAGLVSVNLLVTSSVAAFVVGAVVSGFSVGWFVGLRERRELARRKDKEAILAHGAGEAVLSVSRLGERRAQGPGGRGGGGGGGAGVPPEALLAPLMQNGWAKATLLQGGPHDLDSGLLPTPEQTPLPQKRLPTPHPHPHALGPRAWDHGHPLLPASASSSLLLLAPARAPEQPPAPGEPTPDGRLYAARPGRASHGDFPLTPHASPDRRRVVSAPTGPLDPASAADGLPRPWSPPPTGSLRRPLGPHAPPAATLRRTHTFNSGEARPGDRHRGCHARPGTDLAHLLPYGGADRTAPPVP

SEQ ID NO: 13885 - protein, 785 aa, Artificial Sequence
  Description of Artificial Sequence: Synthetic coding sequence
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQATPWTQTQAVRGRGSRATDGALRPMPTAPRQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQELEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 13886 - protein, 264 aa, Artificial Sequence
  Description of Artificial Sequence: Synthetic coding sequence
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYAR

SEQ ID NO: 13887 - protein, 92 aa, Artificial Sequence
  Description of Artificial Sequence: Synthetic coding sequence
MLVAGLLLWASLLTGAWPSFPTQDHLPATPRVRLSFKELKATGTAHFFNFLLNTTDYRILLKDEDHDRMYVGSKDYVLSLDLHDINREPLIV

SEQ ID NO: 13888 - protein, 754 aa, Artificial Sequence
  Description of Artificial Sequence: Synthetic coding sequence
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQELEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 13889 - protein, 380 aa, Artificial Sequence
  Description of Artificial Sequence: Synthetic coding sequence
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGT

SEQ ID NO: 13890 - protein, 837 aa, Artificial Sequence
  Description of Artificial Sequence: Synthetic coding sequence
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGSRVFTESEKRPLSIQDSFVEVSPVCPRPRVRLGSEIRDSVV

SEQ ID NO: 13891 - protein, 737 aa, Artificial Sequence
  Description of Artificial Sequence: Synthetic coding sequence
MGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSWARTQLLDLSSLYQAVATREDSASSGEIS

SEQ ID NO: 13892 - protein, 837 aa, Artificial Sequence; identical to SEQ ID NO: 13890
  Description of Artificial Sequence: Synthetic coding sequence

SEQ ID NO: 13893 - protein, 91 aa, Artificial Sequence
  Description of Artificial Sequence: Synthetic coding sequence
MLRTAMGLRSWLAAPWGALPPRPPLLLLLLLLLLLQPPPPTWALSPRISLPLGSEERPFLRFEAEHISNYTALLLSRDGRTLYVGAREALF

SEQ ID NO: 13894 - protein, 114 aa, Artificial Sequence
  Description of Artificial Sequence: Synthetic coding sequence
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADA

SEQ ID NO: 13895 - protein, 121 aa, Artificial Sequence
  Description of Artificial Sequence: Synthetic coding sequence
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCS

SEQ ID NO: 13896 - protein, 833 aa, Artificial Sequence
  Description of Artificial Sequence: Synthetic coding sequence
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 13897 - protein, 201 aa, Artificial Sequence
  Description of Artificial Sequence: Synthetic coding sequence
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSM

SEQ ID NO: 13898 - protein, 140 aa, Artificial Sequence
  Description of Artificial Sequence: Synthetic coding sequence
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYV

SEQ ID NO: 13899 - protein, 738 aa, Artificial Sequence
  Description of Artificial Sequence: Synthetic coding sequence
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPASSPKPLPPPGSSSLSCLGHVGDRRLSSPWTPWPASGAGPDSSSRVSLLPPFLSDQAQHVHALGNFYLFCQATGPADIRFVWEKNGRALETCVPVQTHALPDGRAHALSWLQDAIRESAEYRCSVLSSAGNKTSKVQVAVMRPEVTHQERWTRELSAWRAVAGEHDRMMQSWRKAWESCSKDTL

SEQ ID NO: 13900 - protein, 862 aa, Artificial Sequence
  Description of Artificial Sequence: Synthetic coding sequence
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPDKSKGSYRQHFFKHGGTAELKCSQKSNLARVFWKFQNGVLKAESPKYGLMGRKNLLIFNLSEGDSGVYQCLSEERVKNKTVFQVVAKHVLEVKVVPKPVVAPTLSVVQTEGSRIATKVLVASTQGSSPPTPAVQATSSGAITLPPKPAPTGTSCEPKIVINTVPQLHSEKTMYLKSSDNRLLMSLFLFFFVLFLCLFFYNCYKGYLPRQCLKFRSALLIGKKKPKSDFCDREQSLKETLVEPGSFSQQNGEHPKPALDTGYETEQDTITSKVPTDREDSQRIDDLSARDKPFDVKCELKFADSDADGD

SEQ ID NO: 13901 - protein, 59 aa, Artificial Sequence
  Description of Artificial Sequence: Synthetic coding sequence
MRMCTPIRGLLMALAVMFGTAMAFAPIPRITWEHREVHLVQFHEPDIYNYSALLLSEDK

SEQ ID NO: 13902 - protein, 123 aa, Artificial Sequence
  Description of Artificial Sequence: Synthetic coding sequence
MWTQRWKRSVSPGPADIRFVWEKNGRALETCVPVQTHALPDGRAHALSWLQDAIRESAEYRCSVLSSAGNKTSKVQVAVMRPEVTHQERWTRELSAWRAVAGEHDRMMQSWRKAWESCSKDTL

SEQ ID NO: 13903 - protein, 1 aa, Artificial Sequence
  Description of Artificial Sequence: Synthetic coding sequence
M

SEQ ID NO: 13904 - protein, 146 aa, Artificial Sequence
  Description of Artificial Sequence: Synthetic coding sequence
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFL

SEQ ID NO: 13905 - protein, 738 aa, Artificial Sequence; identical to SEQ ID NO: 13899
  Description of Artificial Sequence: Synthetic coding sequence

SEQ ID NO: 13906 - protein, 862 aa, Artificial Sequence; identical to SEQ ID NO: 13900
  Description of Artificial Sequence: Synthetic coding sequence

SEQ ID NO: 13907 - protein, 76 aa, Artificial Sequence
  Description of Artificial Sequence: Synthetic coding sequence
MRMCTPIRGLLMALAVMFGTAMAFAPIPRITWEHREVHLVQFHEPDIYNYSALLLSEDKDTLYIGAREAVFAVNAL

SEQ ID NO: 13908 - protein, 862 aa, Artificial Sequence; identical to SEQ ID NO: 13900
  Description of Artificial Sequence: Synthetic coding sequence

SEQ ID NO: 13909 - protein, 862 aa, Artificial Sequence; identical to SEQ ID NO: 13900
  Description of Artificial Sequence: Synthetic coding sequence

SEQ ID NO: 13910 - protein, 66 aa, Artificial Sequence
  Description of Artificial Sequence: Synthetic coding sequence
MRMCTPIRGLLMALAVMFGTAMAFAPIPRITWEHREVHLVQFHEPDIYNYSALLLSEDKDTLYIGA

SEQ ID NO: 13911 - protein, 770 aa, Artificial Sequence
  Description of Artificial Sequence: Synthetic coding sequence
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 13912 - protein, 127 aa, Artificial Sequence
  Description of Artificial Sequence: Synthetic coding sequence
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEGGSSMLPL

SEQ ID NO: 13913 - protein, 843 aa, Artificial Sequence
  Description of Artificial Sequence: Synthetic coding sequence
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRSQGSRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 13914 - protein, 838 aa, Artificial Sequence
  Description of Artificial Sequence: Synthetic coding sequence
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 13915 - protein, 552 aa, Artificial Sequence
  Description of Artificial Sequence: Synthetic coding sequence
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCHILSGPLPQPHVVTSLSRAWERASLGR

SEQ ID NO: 13916 - protein, 702 aa, Artificial Sequence
  Description of Artificial Sequence: Synthetic coding sequence
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRSQGSRTALIQDIERGNRGCESSRDTGRALQVHMGSMSPPSAWPCVLDGPETRQDLCQPPKPCVHSHAHMEECLSAGLQCPHPHLLLVHSCFIPASGLGVPSQLPHPIWSSSPAPCGDLFVKSLGTGQPGEVRLHHSPPLPSCVALVNQPPHSPWSFSRV

SEQ ID NO: 13917 - protein, 170 aa, Artificial Sequence
  Description of Artificial Sequence: Synthetic coding sequence
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARG

SEQ ID NO: 13918 - protein, 522 aa, Artificial Sequence
  Description of Artificial Sequence: Synthetic coding sequence
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARD

SEQ ID NO: 13919 - protein, 838 aa, Artificial Sequence; identical to SEQ ID NO: 13914
  Description of Artificial Sequence: Synthetic coding sequence

SEQ ID NO: 13920 - protein, 1092 aa, Artificial Sequence
  Description of Artificial Sequence: Synthetic coding sequence
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPGWSPWSEWSKCTDDGAQSRSRHCEELLPGSSACAGNSSQSRPCPYSEIPVILPASSMEEATDCAGKRNRTYLMLRSSQPSGTPLQSLDSFHILLQTAKLCWGPHCFEMGSISSTWWPRASPASWALGS

SEQ ID NO: 13921 - protein, 1151 aa, Artificial Sequence
  Description of Artificial Sequence: Synthetic coding sequence
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 13922 - protein, 1088 aa, Artificial Sequence
  Description of Artificial Sequence: Synthetic coding sequence
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTP

SEQ ID NO: 13923 - protein, 1057 aa, Artificial Sequence
  Description of Artificial Sequence: Synthetic coding sequence
MVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 13924 - protein, 142 aa, Artificial Sequence
  Description of Artificial Sequence: Synthetic coding sequence
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGA

SEQ ID NO: 13925 - protein, 84 aa, Artificial Sequence
  Description of Artificial Sequence: Synthetic coding sequence
MPCGFSPSPVAHHLVPGPPDTPAQQLRCGWTVGGWLLSLVRGLLPCLPPGARTAEGPIMVLAGPLAVSLLLPSLTLLVSHLSSS

SEQ ID NO: 13926 - protein, 1205 aa, Artificial Sequence
  Description of Artificial Sequence: Synthetic coding sequence
MLHLSAEEAIGCVRVRRSFIDELAFGRGHSTGTGKQKRRDRVSGSSWCLACVSWMPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 13927 - protein, 1047 aa, Artificial Sequence
  Description of Artificial Sequence: Synthetic coding sequence
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERYGKCKKTCIASRDPYCGWIKEGGACSHLSPNSRLTFEQDIERGNTDGLGDCHNSFVALNDISTPLPDNEMSYNTVYGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 13928 - protein, 507 aa, Artificial Sequence
  Description of Artificial Sequence: Synthetic coding sequence
MSVYNSEKCSYDGVEDKRIMGMQLDRASSSLYVAFSTCVIKVPLGRCERYGKCKKTCIASRDPYCGWIKEGGACSHLSPNSRLTFEQDIERGNTDGLGDCHNSFVALNGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 13929 - protein, 1030 aa, Artificial Sequence
  Description of Artificial Sequence: Synthetic coding sequence
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERYGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 13930 - protein, 409 aa, Artificial Sequence
  Description of Artificial Sequence: Synthetic coding sequence
MKNASPETREGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 13931 - protein, 114 aa, Artificial Sequence
  Description of Artificial Sequence: Synthetic coding sequence
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHK

SEQ ID NO: 13932 - protein, 1030 aa, Artificial Sequence; identical to SEQ ID NO: 13929
  Description of Artificial Sequence: Synthetic coding sequence

SEQ ID NO: 13933 - protein, 457 aa, Artificial Sequence
  Description of Artificial Sequence: Synthetic coding sequence
MKTGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 13934 - protein, 159 aa, Artificial Sequence
  Description of Artificial Sequence: Synthetic coding sequence
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEF

SEQ ID NO: 13935 - protein, 682 aa, Artificial Sequence
  Description of Artificial Sequence: Synthetic coding sequence
MQTPRASPPRPALLLLLLLLGGAHGLFPEEPPPLSVAPRDYLNHYPVFVGSGPGRLTPAEGADDLNIQRVLRVNRTLFIGDRDNLYRVELEPPTSTELRYQRKLTWRSNPSDINVCRMKGKQEGECRNFVKVLLLRDESTLFVCGSNAFNPVCANYSIDTLQPVGDNISGMARCPYDPKHANVALFSDGMLFTATVTDFLAIDAVIYRSLGDRPTLRTVKHDSKWFKEPYFVHAVEWGSHVYFFFREIAMEFNYLEKVVVSRVARVCKNDVGGSPRVLEKQWTSFLKARLNCSVPGDSHFYFNVLQAVTGVVSLGGRPVVLAVFSTPSNSIPGSAVCAFDLTQVAAVFEGRFREQKSPESIWTPVPEDQVPRPRPGCCAAPGMQYNASSALPDDILNFVKTHPLMDEAVPSLGHAPWILRTLMRHQLTRVAVDVGAGPWGNQTVVFLGSEAGTVLKFLVRPNASTSGTSGLSVFLEEFETYRPDRCGRPGGGETGQRLLSLELDAASGGLLAAFPRCVVRVPVARCQQYSGCMKNCIGSQDPYCGWAPDGSCIFLSPGTRAAFEQDVSGASTSGLGDCTGLLRASLSEDRAGLVSVNLLVTSSVAAFVVGAVVSGFSVGWFVGLRERRELARRKDKEAILAHGAGEAVLSVSRLGERRAQGPGSRRWGFQKARGSPRCRLGV

SEQ ID NO: 13936 - protein, 888 aa, Artificial Sequence; identical to SEQ ID NO: 13884
  Description of Artificial Sequence: Synthetic coding sequence

SEQ ID NO: 13937 - protein, 930 aa, Artificial Sequence
  Description of Artificial Sequence: Synthetic coding sequence
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 13938 - protein, 922 aa, Artificial Sequence
  Description of Artificial Sequence: Synthetic coding sequence
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYVLPGPGPSPGTPSPPSDAHPRPQSSTLGVHTRGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 13939 - protein, 962 aa, Artificial Sequence
  Description of Artificial Sequence: Synthetic coding sequence
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYVLPGPGPSPGTPSPPSDAHPRPQSSTLGVHTRGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 13940 - protein, 930 aa, Artificial Sequence; identical to SEQ ID NO: 13937
  Description of Artificial Sequence: Synthetic coding sequence

SEQ ID NO: 13941 - protein, 537 aa, Artificial Sequence
  Description of Artificial Sequence: Synthetic coding sequence
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCPAHSSPLGRSLQVLRGSREAPPVPGPARGLPGPRPEKGGRREAPVVPEASPRRALLPPGRPERRPFQLLKGAAHGLQRGERPSPLGHELDALQDVSPPPRPAPPAFPTRRVSRGPFSPRVYLLTVFPPVLDRRVGGEKPVSSVSQHFRGSWRTPTPRSLPAKLP

SEQ ID NO: 13942 - protein, 1073 aa, Artificial Sequence
  Description of Artificial Sequence: Synthetic coding sequence
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 13943 - protein, 1017 aa, Artificial Sequence
  Description of Artificial Sequence: Synthetic coding sequence
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 13944 - protein, 597 aa, Artificial Sequence
  Description of Artificial Sequence: Synthetic coding sequence
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHDMEVSSSSVTTMVYDGKSSLESPTRWST

SEQ ID NO: 13945 - protein, 1011 aa, Artificial Sequence
  Description of Artificial Sequence: Synthetic coding sequence
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLLLTEDFFAFHNHSAEGYEQDTEFGNTAHLGDCHGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 13946 - protein, 476 aa, Artificial Sequence
  Description of Artificial Sequence: Synthetic coding sequence
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAK

SEQ ID NO: 13947 - protein, 998 aa, Artificial Sequence
  Description of Artificial Sequence: Synthetic coding sequence
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 13948 - protein, 1030 aa, Artificial Sequence
  Description of Artificial Sequence: Synthetic coding sequence
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLLLTEDFFAFHNHSAEGYEQDTEFGNTAHLGDCHEILPTSTTPDYKIFGGPTSGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 13949 - protein, 1054 aa, Artificial Sequence
  Description of Artificial Sequence: Synthetic coding sequence
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 13950 - protein, 1073 aa, Artificial Sequence; identical to SEQ ID NO: 13942
  Description of Artificial Sequence: Synthetic coding sequence

SEQ ID NO: 13951 - protein, 1011 aa, Artificial Sequence; identical to SEQ ID NO: 13945
  Description of Artificial Sequence: Synthetic coding sequence

SEQ ID NO: 13952 - protein, 1011 aa, Artificial Sequence; identical to SEQ ID NO: 13945
  Description of Artificial Sequence: Synthetic coding sequence

SEQ ID NO: 13953 - protein, 597 aa, Artificial Sequence; identical to SEQ ID NO: 13944
  Description of Artificial Sequence: Synthetic coding sequence

SEQ ID NO: 13954 - protein, 22 aa, Artificial Sequence
  Description of Artificial Sequence: Synthetic coding sequence
MRVFLLCAYILLLMVSQLRAVS

SEQ ID NO: 13955 - protein, 219 aa, Artificial Sequence
  Description of Artificial Sequence: Synthetic coding sequence
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIK

SEQ ID NO: 13956 - protein, 1 aa, Artificial Sequence
  Description of Artificial Sequence: Synthetic coding sequence
M

SEQ ID NO: 13957 - protein, 148 aa, Artificial Sequence
  Description of Artificial Sequence: Synthetic coding sequence
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYY

SEQ ID NO: 13958 - protein, 329 aa, Artificial Sequence
  Description of Artificial Sequence: Synthetic coding sequence
MDGPVAEHAKQEPFHVVTPLLESWALSQVAGMPVFLKCENVQPSGSFKIRGIGHFCQEMAKKGCRHLVCSSGGNAGIAAAYAARKLGIPATIVLPESTSLQVVQRLQGEGAEVQLTGKVWDEANLRAQELAKRDGWENVPPFDHPLIWKGHASLVQELKAVLRTPPGALVLAVGGGGLLAGVVAGLLEVGWQHVPIIAMETHGAHCFNAAITAGKLVTLPDITSVAKSLGAKTVAARALECMQVCKIHSEVVEDTEAVSAVQQLLDDERMLVEPACGAALAAIYSGLLRRLQAEGCLPPSLTSVVVIVCGGNNINSRELQALKTHLGQV

SEQ ID NO: 13959 - protein, 329 aa, Artificial Sequence; identical to SEQ ID NO: 13958
  Description of Artificial Sequence: Synthetic coding sequence

SEQ ID NO: 13960 - protein, 29 aa, Artificial Sequence
  Description of Artificial Sequence: Synthetic coding sequence
MDGPVAEHAKQEPFHVVTPLLESWALSQV

SEQ ID NO: 13961 - protein, 453 aa, Artificial Sequence
  Description of Artificial Sequence: Synthetic coding sequence
MGSVLGLCSMASWIPCLCGSAPCLLCRCCPSGNNSTVTRLIYALFLLVGVCVACVMLIPGMEEQLNKIPGFCENEKGVVPCNILVGYKAVYRLCFGLAMFYLLLSLLMIKVKSSSDPRAAVHNGFWFFKFAAAIAIIIGAFFIPEGTFTTVWFYVGMAGAFCFILIQLVLLIDFAHSWNESWVEKMEEGNSRCWYAALLSATALNYLLSLVAIVLFFVYYTHPASCSENKAFISVNMLLCVGASVMSILPKIQESQPRSGLLQSSVITVYTMYLTWSAMTNEPETNCNPSLLSIIGYNTTSTVPKEGQSVQWWHAQGIIGLILFLLCVFYSSIRTSNNSQVNKLTLTSDESTLIEDGGARSDGSLEDGDDVHRAVDNERDGVTYSYSFFHFMLFLASLYIMMTLTNWYRYEPSREMKSQWTAVWVKISSSWIGIVLYVWTLVAPLVLTNRDFD

SEQ ID NO: 13962 - protein, 453 aa, Artificial Sequence; identical to SEQ ID NO: 13961
  Description of Artificial Sequence: Synthetic coding sequence

SEQ ID NO: 13963 - protein, 455 aa, Artificial Sequence
  Description of Artificial Sequence: Synthetic coding sequence
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 13964 - protein, 464 aa, Artificial Sequence
  Description of Artificial Sequence: Synthetic coding sequence
MDGRMMRSMRLREEESPGPSHTASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 13965 - protein, 459 aa, Artificial Sequence
  Description of Artificial Sequence: Synthetic coding sequence
MGAEGAPDFLSCPRVRRASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 13966 - protein, 459 aa, Artificial Sequence
  Description of Artificial Sequence: Synthetic coding sequence
MRSMRLREEESPGPSHTASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 13967 - protein, 274 aa, Artificial Sequence
  Description of Artificial Sequence: Synthetic coding sequence
MSISSQHGITLASVEALHSSYCSWCLLQLLPIPGTRTEQPRSGLLQASVISCYIMYLTFSALSSRPPERVILQGQNHTLCLPGLSKMEPQTPDISLAMLSASIMYACVLFACNEASYLAEVFGPLWIVKVYSYEFQKPSLCFCCPETVEADKGQRGGAARPADQETPPAPPVQVQHLSYNYSAFHFVFFLASLYVMVTLTNWFSYEGAELEKTFIKGSWATFWVKVASCWACVLLYLGLLLAPLCWPPTQKPQPLILRRRRHRIISPDNKYPPV

SEQ ID NO: 13968 - protein, 518 aa, Artificial Sequence
  Description of Artificial Sequence: Synthetic coding sequence
MVGAKAGPSPGTSLGLAQQHSGGSSVLVKSPFCQVCCCGPAPCASCCHSRWPSLTASTCSRLFYILLHVGASAICCLLLSRTVVERVWGKTHRIQMPSGLCAHLFGLSDCPVLSGSGAVYRVCAGTATFHLLQAVLLVHLHSPTSPRAQLHNSFWLLKLLFLLGLCAIAFCIPDEHLFPAWHYIGICGGFAFILLQLVLITAFAHSWNKNWQTGAAQDCSWFLAVLLATLGFYSMAGVGAVLLFHYYTHPAGCLLNKMLLSLHLCFCGLISFLSIAPCIRLKQPRSGLLQASVISCYIMYLTFSALSSRPPERVILQGQNHTLCLPGLSKMEPQTPDISLAMLSASIMYACVLFACNEASYLAEVFGPLWIVKVYSYEFQKPSLCFCCPETVEADKGQRGGAARPADQETPPAPPVQVQHLSYNYSAFHFVFFLASLYVMVTLTNWFSYEGAELEKTFIKGSWATFWVKVASCWACVLLYLGLLLAPLCWPPTQKPQPLILRRRRHRIISPDNKYPPV

SEQ ID NO: 13969 - protein, 96 aa, Artificial Sequence
  Description of Artificial Sequence: Synthetic coding sequence
MVGAKAGPSPGTSLGLAQQHSGGSSVLVKSPFCQQVSTSLPCICSTPRCAAVGLLLVPAAATLGGPLSPHPLAAACSTSSSMWGPQQSAASCCQGQ

SEQ ID NO: 13970 - protein, 422 aa, Artificial Sequence
  Description of Artificial Sequence: Synthetic coding sequence
TGSCCVDQLACCCGSAGCSLCCDCCPRIRQSLSTRFMYALYFILVVVLCCIMMSTTVAHKMKEHIPFFEDMCKGIKAGDTCEKLVGYSAVYRVCFGMACFFFIFCLLTLKINNSKSCRAHIHNGFWFFKLLLLGAMCSGAFFIPDQDTFLNAWRYVGAVGGFLFIGIQLLLLVEFAHKWNKNWTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVVLDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFNHVRSAFHLLP

SEQ ID NO: 13971 - protein, 423 aa, Artificial Sequence
  Description of Artificial Sequence: Synthetic coding sequence
MSAQCCAGQLACCCGSAGCSLCCDCCPRIRQSLSTRFMYALYFILVVVLCCIMMSTTVAHKMKEHIPFFEDMCKGIKAGDTCEKLVGYSAVYRVCFGMACFFFIFCLLTLKINNSKSCRAHIHNGFWFFKLLLLGAMCSGAFFIPDQDTFLNAWRYVGAVGGFLFIGIQLLLLVEFAHKWNKNWTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVVLDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFNHVRSAFHLLP

SEQ ID NO: 13972 - protein, 456 aa, Artificial Sequence
  Description of Artificial Sequence: Synthetic coding sequence
MSAQCCAGQLACCCGSAGCSLCCDCCPRIRQSLSTRFMYALYFILVVVLCCIMMSTTVAHKMKEHIPFFEDMCKGIKAGDTCEKLVGYSAVYRVCFGMACFFFIFCLLTLKINNSKSCRAHIHNGFWFFKLLLLGAMCSGAFFIPDQDTFLNAWRYVGAVGGFLFIGIQLLLLVEFAHKWNKNWTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFKWSPTLLPRLEYSGMILAHCNLHLPDVKRFSCLSLPSSWGYRHVPP

SEQ ID NO: 13973 - protein, 461 aa, Artificial Sequence
  Description of Artificial Sequence: Synthetic coding sequence
MSAQCCAGQLACCCGSAGCSLCCDCCPRIRQSLSTRFMYALYFILVVVLCCIMMSTTVAHKMKEHIPFFEDMCKGIKAGDTCEKLVGYSAVYRVCFGMACFFFIFCLLTLKINNSKSCRAHIHNGFWFFKLLLLGAMCSGAFFIPDQDTFLNAWRYVGAVGGFLFIGIQLLLLVEFAHKWNKNWTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVVLDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFNYESANIESFFSGSWSIFWVKMASCWICVLLYLCTLVAPLCCPTREFSV

SEQ ID NO: 13974 - protein, 71 aa, Artificial Sequence
  Description of Artificial Sequence: Synthetic coding sequence
MAGMALARAWKQMSWFYYQYLLVTALYMLEPWERTVFNSMLVSIVGMALYTGYVFMPQHIMAILHYFEIVQ

SEQ ID NO: 13975 - protein, 76 aa, Artificial Sequence
  Description of Artificial Sequence: Synthetic coding sequence
MDLRRVKEYFSWLYYQYQIISCCAVLEPWERSMFNTILLTIIAMVVYTAYVFIPIHIRLAWEFFSKICGYHSTISN

SEQ ID NO: 13976 - protein, 76 aa, Artificial Sequence; identical to SEQ ID NO: 13975
  Description of Artificial Sequence: Synthetic coding sequence

SEQ ID NO: 13977 - protein, 305 aa, Artificial Sequence
  Description of Artificial Sequence: Synthetic coding sequence
MGHALCVCSRGTVIIDNKRYLFIQKLGEGGFSYVDLVEGLHDGHFYALKRILCHEQQDREEAQREADMHRLFNHPNILRLVAYCLRERGAKHEAWLLLPFFKRGTLWNEIERLKDKGNFLTEDQILWLLLGICRGLEAIHAKGYAHRDLKPTNILLGDEGQPVLMDLGSMNQACIHVEGSRQALTLQDWAAQRCTISYRAPELFSVQSHCVIDERTDVWSLGCVLYAMMFGEGPYDMVFQKGDSVALAVQNQLSIPQSPRHSSALRQLLNSMMTVDPHQRPHIPLLLSQLEALQPPAPGQHTTQI

SEQ ID NO: 13978 - protein, 305 aa, Artificial Sequence; identical to SEQ ID NO: 13977
  Description of Artificial Sequence: Synthetic coding sequence

SEQ ID NO: 13979 - protein, 422 aa, Artificial Sequence
  Description of Artificial Sequence: Synthetic coding sequence
MGMTRMLLECSLSDKLCVIQEKQYEVIIVPTLLVTIFLILLGVILWLFIREQRTQQQRSGPQGIAPVPPPRDLSWEAGHGGNVALPLKETSVENFLGATTPALAKLQVPREQLSEVLEQICSGSCGPIFRANMNTGDPSKPKSVILKALKEPAGLHEVQDFLGRIQFHQYLGKHKNLVQLEGCCTEKLPLYMVLEDVAQGDLLSFLWTCRRDVMTMDGLLYDLTEKQVYHIGKQVLLALEFLQEKHLFHGDVAARNILMQSDLTAKLCGLGLAYEVYTRGAISSTQTIPLKWLAPERLLLRPASIRADVWSFGILLYEMVTLGAPPYPEVPPTSILEHLQRRKIMKRPSSCTHTMYSIMKSCWRWREADRPSPRELRLRLEAAIKTADDEAVLQVPELVVPELYAAVAGIRVESLFYNYSML

SEQ ID NO: 13980 - protein, 65 aa, Artificial Sequence
  Description of Artificial Sequence: Synthetic coding sequence
MGMTRMLLECSLSDKLCVIQEKQYEVIIVPTLLVTIFLILLGVILWLFIREQRTQQQRSGPQGKA

SEQ ID NO: 13981 - protein, 83 aa, Artificial Sequence
  Description of Artificial Sequence: Synthetic coding sequence
MGMTRMLLECSLSDKLCVIQEKQYEVIIVPTLLVTIFLILLGVILWLFIREQRTQQQRSGPQGIAPVPPPRDLSWEAGHGGNV

SEQ ID NO: 13982 - protein, 41 aa, Artificial Sequence
  Description of Artificial Sequence: Synthetic coding sequence
MGMTRMLLECSLSDKLCVIQEKQYEVIIVPTLLVTIFLILL

SEQ ID NO: 13983 - protein, 87 aa, Artificial Sequence
  Description of Artificial Sequence: Synthetic coding sequence
MGMTRMLLECSLSDKLCVIQEKQYEVIIVPTLLVTIFLILLGVILWLFIREQRTQQQRSGPQGIAPVPPPRDLSWEAGHGGNVALPL

SEQ ID NO: 13984 - protein, 107 aa, Artificial Sequence
  Description of Artificial Sequence: Synthetic coding sequence
MSEPDTSSGFSGSVENGTFLELFPTSLSTSVDPSSGHLSNVYIYVSIFLSLLAFLLLLLIIALQRLKNIISSSSSYPEYPSDAGSSFTNLEVCSISSQRSTFSNLSS

SEQ ID NO: 13985 - protein, 393 aa, Artificial Sequence
  Description of Artificial Sequence: Synthetic coding sequence
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSSFSHYSGLKHEDKRGGSGSHNWGTVKDELTDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 13986 - protein, 402 aa, Artificial Sequence
  Description of Artificial Sequence: Synthetic coding sequence
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSGLKHEDKRGGSGSHNWGTVKDELTESPKYIQKQISYNYSDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 13987 - protein, 387 aa, Artificial Sequence
  Description of Artificial Sequence: Synthetic coding sequence
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSGLKHEDKRGGSGSHNWGTVKDELTDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 13988 - protein, 408 aa, Artificial Sequence
  Description of Artificial Sequence: Synthetic coding sequence
MPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQGEGKIIDRRPERRPPRERRFEKPLEEKGEGGEFSVDRPIIDRPIRGRGGLGRGRGGRGRGMGRGDGFDSRGKREFDRHSGSDRSSFSHYSGLKHEDKRGGSGSHNWGTVKDELTESPKYIQKQISYNYSDLDQSNVTEETPEGEEHHPVADTENKENEVEEVKEEGPKEMTLDEWKAIQNKDRAKVEFNIRKPNEGADGQWKKGFVLHKSKSEEAHAEDSVMDHHFRKPANDITSQLEINFGDLGRPGRGGRGGRGGRGRGGRPNRGSRTDKSSASAPDVDDPEAFPALA

SEQ ID NO: 13989 - protein, 270 aa, Artificial Sequence
  Description of Artificial Sequence: Synthetic coding sequence
MFFSLHRETPKEGMFGANLTTFHPTLFILLGIPGLEQYHIWLSIPFYLMYITAVLGNGALILVVLSEHTLHVFLSMLAGTDILLSTTTVPKALAIFWVHAGEIAFDACITQMFFIHVAFVAESGILLAMAFDSYVAICTPLRYTTILTSMVNGKMTLTIWGQSIGTIFPVIFLLKRLPYCQTNIIPHSYCEHIGVAQLACADITVNIWYGFSVPMASVLVDVAFIGFSYTLILQAVFRLPSQESQHKALNTCGSTLELFSSSSSHHFLLS

SEQ ID NO: 13990 - protein, 225 aa, Artificial Sequence
  Description of Artificial Sequence: Synthetic coding sequence
MFAGMDTFLLAVIAYDRFVAICHPLQYMVIINPHLCGLLVLASWFIIFWFSLVHILLMKRLTFSTGTEIPHFFCELAQVLKVARSDALLINIVLYVAMALLGVFPVAGILFSYSQIVSSLMRMSSTEGKYKAFSTCGSHLCVVSLFYGTGLGVYLSSAVTHSSQSSSMASVMYAMVTPMLNPFIYSLRNKDVKGALGRLLSRAASCLLRYTTSELRGCYGSLKQM

SEQ ID NO: 13991 - protein, 159 aa, Artificial Sequence
  Description of Artificial Sequence: Synthetic coding sequence
MEKLRRVLSGQDDEEQGLTAQVLDASSLSFNTRLKWFAICFVCGVFFSILGTGLLWLPGGIKLFAVFYTLGNLAALASTCFLMGPVKQLKKMFEATRLLATIVMLLCFIFTLCAALWWHKKGLAVLFCILQFLSMTWYSLSYIPYARDAVIKCCSSLLS

SEQ ID NO: 13992 - protein, 160 aa, Artificial Sequence
  Description of Artificial Sequence: Synthetic coding sequence
MDKLKKVLSGQDTEDRSGLSEVVEASSLSWSTRIKGFIACFAIGILCSLLGTVLLWVPRKGLHLFAVFYTFGNIASIGSTIFLMGPVKQLKRMFEPTRLIATIMVLLCFALTLCSAFWWHNKGLALIFCILQSLALTWYSLSFIPFARDAVKKCFAVCLA

SEQ ID NO: 13993 - protein, 108 aa, Artificial Sequence
  Description of Artificial Sequence: Synthetic coding sequence
MDKLKKVLSGQDTEDRSGLSEVVEASSLSWSTRIKGFIACFAIGILCSLLGTVLLWVPRKGLHLFAVFYTFGNIASIGSCVLHLPCVLPFGGITRDLHLSSAFCSLWH

SEQ ID NO: 13994 - protein, 108 aa, Artificial Sequence; identical to SEQ ID NO: 13993
  Description of Artificial Sequence: Synthetic coding sequence

SEQ ID NO: 13995 - protein, 215 aa, Artificial Sequence
  Description of Artificial Sequence: Synthetic coding sequence
MADLHRQLQEYLAQGKAGGPAAAEPLLAAEKAEEPGDRPAEEWLGRAGLRWTWARSPAESAAAGLTCLPSVTRGQRLAAGGGCLLLAALCFGLAALYAPVLLLRARKFALLWSLGSALALAGSALLRGGAACGRLLRCEEAPSRPALLYMAALGATLFAALGLRSTLLTVLGAGAQVAALLAALVGLLPWGGGTALRLALGRLGRGAGLAKVLPV

SEQ ID NO: 13996 - protein, 2161 aa, Artificial Sequence
  Description of Artificial Sequence: Synthetic coding sequence
MTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSLMDGIGPGSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 13997 - protein, 2152 aa, Artificial Sequence
  Description of Artificial Sequence: Synthetic coding sequence
MTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 13998 - protein, 1548 aa, Artificial Sequence
  Description of Artificial Sequence: Synthetic coding sequence
MQLMALEQRFGSGLPGGGQPLCLMMSSPLPPPPPHFSCLPASDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 13999 - protein, 2169 aa, Artificial Sequence
  Description of Artificial Sequence: Synthetic coding sequence
MTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSLMDGIGPGSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMVSPWKKKSEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTSPPEPPYSTPPVPSSSGRLTPSPRGGPFNPGSGGPLPASSPASFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYFQLPPRAASAAMYVPARSGRGRKGPLVKQTKVEGEPQKGGGLPPAPSPTSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASSLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 14000 - protein, 365 aa, Artificial Sequence
  Description of Artificial Sequence: Synthetic coding sequence
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 14001 - protein, 386 aa, Artificial Sequence
  Description of Artificial Sequence: Synthetic coding sequence
MNIMDFNVKKLAADAGTFLSRAVQFTEEKLGQAEKTELDAHLENLLSKAECTKIWTEKIMKQTEVLLQPNPNARIEEFVYEKLDRKAPSRINNPELLGQYMIDAGTEFGPGTAYGNALIKCGETQKRIGTADRELIQTSALNFLTPLRNFIEGDYKTIAKERKLLQNKRLDLDAAKTRLKKAKAAETRNSQLNSARLEGDNIMIWAEEVTKSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 14002 - protein, 265 aa, Artificial Sequence
  Description of Artificial Sequence: Synthetic coding sequence
MIDAGTEFGPGTAYGNALIKCGETQKRIGTADRELIQTSALNFLTPLRNFIEGDYKTIAKERKLLQNKRLDLDAAKTRLKKAKAAETRNSSEQELRITQSEFDRQAEITRLLLEGISSTHAHHLRCLNDFVEAQMTYYAQCYQYMLDLQKQLGSFPSNYLSNNNQTSVTPVPSVLPNAIGSSAMASTSGLVITSPSNLSDLKECSGSRKARVLYDYDAANSTELSLLADEVITVFSVVGMDSDWLMGERGNQKGKVPITYLELLN

SEQ ID NO: 14003 - protein, 707 aa, Artificial Sequence
  Description of Artificial Sequence: Synthetic coding sequence
MAAAATAAEGVPSRGPPGEVIHLNVGGKRFSTSRQTLTWIPDSFFSSLLSGRISTLKDETGAIFIDRDPTVFAPILNFLRTKELDPRGVHGSSLLHEAQFYGLTPLVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPETVGSGPQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 14004 - protein, 487 aa, Artificial Sequence [sequence omitted]

SEQ ID NO: 14005 - protein, 630 aa, Artificial Sequence
  Description of Artificial Sequence: Synthetic coding sequence
MRERGQDSLAGLVLYVGLFGHPGMLHRAKYSRFRNESITSLDEGSSGGSVGNKGSPQPPHPALAPHLPTEDATLPSQESPTPLCTLIPRMASMKLANPATLLSLKNFCLGTKEVPRLKLQESRDPGSSGPSSPETSLSRSGTAPPPQQDLVGHRATALTPDSCPLPGPGEPTLRSRQDRHFLQHLLGMGMNYCVRYMGCVEVLQSMRSLDFGMRTQVTREAISRLCEAVPGANGAIKKRKPPVKFLSTVLGKSNLQFSGMNIKLTISTCSLTLMNLDNQQIIANHHMQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYLPGNSKCSSVYENCLEQSRAIGNVHPRGVQSQRDTSLLKHTCRVDLFDDPCYINTQALQSTPGSAGNQRSAQPLGSPWHCGKAPETVQPGATAQPASSHSLPHIKQQLWSEECYHGKLSRKAAESLLVKDGDFLVRESATSPGQYVLSGLQGGQAKHLLLVDPEGKVRTKDHVFDNVGHLIRYHMDNSLPIISSGSEVSLKQPVRKDNNPALLHSNK

SEQ ID NO: 14006 - protein, 387 aa, Artificial Sequence
  Description of Artificial Sequence: Synthetic coding sequence
MLPALEHWIPKFFSFRTRTGSPLSLACRQPIVGPCDHIIANHHMQSISFASGGDPDTTDYVAYVAKDPVNQRACHILECHNGMAQDVISTIGQAFELRFKQYLKNPSLNTSCESEEVHIDSHAEEREDHEYYNEIPGKQPPVGGVSDMRIKVQATEQMAYCPIQCEKLCYLPGNSKCSSVYENCLEQSRAIGNVHPRGVQSQRDTSLLKHTCRVDLFDDPCYINTQALQSTPGSAGNQRSAQPLGSPWHCGKAPETVQPGATAQPASSHSLPHIKQQLWSEECYHGKLSRKAAESLLVKDGDFLVRESATSPGQYVLSGLQGGQAKHLLLVDPEGKVRTKDHVFDNVGHLIRYHMDNSLPIISSGSEVSLKQPVRKDNNPALLHSNK

SEQ ID NO: 14007 - protein, 295 aa, Artificial Sequence
  Description of Artificial Sequence: Synthetic coding sequence
MWGARRSSVSSSWNAASLLQLLLAALLAAGARASGEYCHGWLDAQGVWRIGFQCPERFDGGDATICCGSCALRYCCSSAEARLDQGGCDNDRQQGAGEPGRADKDGPDGSAVPIYVPFLIVGSVFVAFIILGSLVAACCCRCLRPKQDPQQSRAPGGNRLMETIPMIPSASTSRGSSSRQSSTAASSSSSANSGARAPPTRSQTNCCLPEGTMNNVYVNMPTNFSVLNCQQATQIVPHQGQYLHPPYVGYTVQHDSVPMTAVPPFMDGLQPGYRQIQSPFPHTNSEQKMYPAVTV

SEQ ID NO: 14008 - protein, 238 aa, Artificial Sequence
  Description of Artificial Sequence: Synthetic coding sequence
MRALLALCLLLGWLRWGPAGAQQSGEYCHGWVDVQGNYHEGFQCPEDFDTLDATICCGSCALRYCCAAADARLEQGGCTNDRRELEHPGITAQPVYVPFLIVGSIFIAFIILGSVVAIYCCTCLRPKEPSQQPIRFSLRSYQTETLPMILTSTSPRAPSRQSSTATSSSSTGGSIRRFSFARAEPGCLVPSPPPPYTTSHSIHLAQPSGFLVSPQYFAYPLQQEPPLPGKSCPDFSSS

SEQ ID NO: 14009 - protein, 197 aa, Artificial Sequence
  Description of Artificial Sequence: Synthetic coding sequence
MPPAGLRRAAPLTAIALLVLGAPLVLAGEDCLWYLDRNGSWHPGFNCEFFTFCCGTCYHRYCCRDLTLLITERQQKHCLAFSPKTIAGIASAVILFVAVVATTICCFLCSCCYLYRRRQQLQSPFEGQEIPMTGIPVQPVYPYPQDPKAGPAPPQPGFIYPPSGPAPQYPLYPAGPPVYNPAAPPPYMPPQPSYPGA

SEQ ID NO: 14010 - protein, 500 aa, Artificial Sequence
  Description of Artificial Sequence: Synthetic coding sequence
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPEKPRMNNILTSATEPYDLSFSRSFQNLAHLPPSYESAVKTNPSKYSSLKRLTDKEADEYYMRRRHLPDLAARGTLPLNVIQMSQQKPLPRERPRRPIRAMSQDRVLSPDRGLPDEFSMPYDRILSDEQLLSTERLHSQDPLLSPERTAFPEQSLSRAISHTDVFVSTPVLDRYRMSKMHSHPSASNNSYATLGQSQTAAKRHAFASRRHNTVEQLHYIPGHHTCYTASKTEVTV

SEQ ID NO: 14011 - protein, 532 aa, Artificial Sequence
  Description of Artificial Sequence: Synthetic coding sequence
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPGHYGKDAYRSGGPDLHNFISSGFVTLGRGHTKEKPRMNNILTSATEPYDLSFSRSFQNLAHLPPSYESAVKTNPSKYSSLKRLTDKEADEYYMRRRHLPDLAARGTLPLNVIQMSQQKPLPRERPRRPIRAMSQDRVLSPDRGLPDEFSMPYDRILSDEQLLSTERLHSQDPLLSPERTAFPEQSLSRAISHTDVFVSTPVLDRYRMSKMHSHPSASNNSYATLGQSQTAAKRHAFASRRHNTVEQLHYIPGHHTCYTASKTEVTV

SEQ ID NO: 14012 - protein, 551 aa, Artificial Sequence
  Description of Artificial Sequence: Synthetic coding sequence
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPGHYGKDAYRSGGPDLHNFISSGFVTLGRGHTKGDHQYNHPILSSVTQIPPHEKPRMNNILTSATEPYDLSFSRSFQNLAHLPPSYESAVKTNPSKYSSLKRLTDKEADEYYMRRRHLPDLAARGTLPLNVIQMSQQKPLPRERPRRPIRAMSQDRVLSPDRGLPDEFSMPYDRILSDEQLLSTERLHSQDPLLSPERTAFPEQSLSRAISHTDVFVSTPVLDRYRMSKMHSHPSASNNSYATLGQSQTAAKRHAFASRRHNTVEQLHYIPGHHTCYTASKTEVTV

SEQ ID NO: 14013 - protein, 309 aa, Artificial Sequence
  Description of Artificial Sequence: Synthetic coding sequence
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFFIKTGMFEGCTTGCPSLLPILEPKYAVEKIVEAILQEKMYLYMPKLLYFMMFLKSFLPLKTGLLIADYLGILHAMDGFVDQKKKL

SEQ ID NO: 14014 - protein, 265 aa, Artificial Sequence
  Description of Artificial Sequence: Synthetic coding sequence
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQTYKAFLPAMIANDHGHLVCISSSAGLSGVNGLADYCASKFAAFGFAESVFVETFVQKQKGIKTTIVCPFFIKTGMFEGCTTGCPSLLPILEPKYAVEKIVEAILQEKMYLYMPKLLYFMMFLKSFLPLKTGLLIADYLGILHAMDGFVDQKKKL

SEQ ID NO: 14015 - protein, 230 aa, Artificial Sequence
  Description of Artificial Sequence: Synthetic coding sequence
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFYKNWNV

SEQ ID NO: 14016 - protein, 393 aa, Artificial Sequence
  Description of Artificial Sequence: Synthetic coding sequence
MDPKRSQKESVLITGGSGYFGFRLGCALNQNGVHVILFDISSPAQTIPEGIKFIQGDIRHLSDVEKAFQDADVTCVFHIASYGMSGREQLNRNLIKEVNVRGTDNILQVCQRRRVPRLVYTSTFNVIFGGQVIRNGDESLPYLPLHLHPDHYSRTKSIAEQKVLEANATPLDRGDGVLRTCALRPAGIYGPGEQRHLPRIVSYIEKGLFKFVYGDPRSLVEFVHVDNLVQAHILASEALRADKGHIASGQPYFISDGRPVNNFEFFRPLVEGLGYTFPSTRLPLTLVYCFAFLTEMVHFILGRLYNFQPFLTRTEVYKTGVTHYFSLEKAKKELGYKAQPFDLQEAVEWFKAHGHGRSSGSRDSECFVWDGLLVFLLIIAVLMWLPSSVILSL

SEQ ID NO: 14017 - protein, 122 aa, Artificial Sequence
  Description of Artificial Sequence: Synthetic coding sequence
MDGSRKEEEEDSTFTNISLADDIDHSSRILYPRPKSLLPKMMNADMDAVDAENQVELEEKTRLINQVLELQHTLEDLSARVDAVKEENLKLKSENQVLGQYIENLMSASSVFQTTDTKSKRK

SEQ ID NO: 14018 - protein, 159 aa, Artificial Sequence
  Description of Artificial Sequence: Synthetic coding sequence
MRRRVFSSQDWRASGWDGMGFFSRRTFCGRSGRSCRGQLVQVSRPEVSAGSLLLPAPQAEDHSSRILYPRPKSLLPKMMNADMDAVDAENQVELEEKTRLINQVLELQHTLEDLSARVDAVKEENLKLKSENQVLGQYIENLMSASSVFQTTDTKSKRK

SEQ ID NO: 14019 - protein, 122 aa, Artificial Sequence; identical to SEQ ID NO: 14017
  Description of Artificial Sequence: Synthetic coding sequence

SEQ ID NO: 14020 - protein, 122 aa, Artificial Sequence; identical to SEQ ID NO: 14017
  Description of Artificial Sequence: Synthetic coding sequence

SEQ ID NO: 14021 - protein, 131 aa, Artificial Sequence
  Description of Artificial Sequence: Synthetic coding sequence
MRRRVFSSQDWRASGWDGMGFFSRRTFCGRSGRSCRGQLVQVSRPEVSAGSLLLPAPQAEDHSSRILYPRPKSLLPKMMNADMDDLSARVDAVKEENLKLKSENQVLGQYIENLMSASSVFQTTDTKSKRK

SEQ ID NO: 14022 - protein, 396 aa, Artificial Sequence
  Description of Artificial Sequence: Synthetic coding sequence
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQVKRQGAQVTTERTVQLNVSYAPQNLAISIFFRNGTGTALRILSNGMSVPIQEGQSLFLACTVDSNPPASLSWFREGKALNPSQTSMSGTLELPNIGAREGGEFTCRVQHPLGSQHLSFILSVQRSSSSCICVTEKQQGSWPLVLTLIRGALMGAGFLLTYGLTWIYYTRCGGPQQSRAERPG

SEQ ID NO: 14023 - protein, 328 aa, Artificial Sequence
  Description of Artificial Sequence: Synthetic coding sequence
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 14024 - protein, 174 aa, Artificial Sequence
  Description of Artificial Sequence: Synthetic coding sequence
MTATRAATASGSAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 14025 - protein, 497 aa, Artificial Sequence
  Description of Artificial Sequence: Synthetic coding sequence
MMSSAAFPRWLQSMGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 14026 - protein, 484 aa, Artificial Sequence
  Description of Artificial Sequence: Synthetic coding sequence
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 14027 - protein, 496 aa, Artificial Sequence
  Description of Artificial Sequence: Synthetic coding sequence
MMSSAAFPRWLSMGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 14028 - protein, 484 aa, Artificial Sequence; identical to SEQ ID NO: 14026
  Description of Artificial Sequence: Synthetic coding sequence

SEQ ID NO: 14029 - protein, 484 aa, Artificial Sequence; identical to SEQ ID NO: 14026
  Description of Artificial Sequence: Synthetic coding sequence

SEQ ID NO: 14030 - protein, 260 aa, Artificial Sequence
  Description of Artificial Sequence: Synthetic coding sequence
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSF

SEQ ID NO: 14031 - protein, 188 aa, Artificial Sequence
  Description of Artificial Sequence: Synthetic coding sequence
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFG

SEQ ID NO: 14032 - protein, 494 aa, Artificial Sequence
  Description of Artificial Sequence: Synthetic coding sequence
MKLQEGHTVLLSLPLRLAGTETEHGGPSYPFTDSALRAGEDGPDLPRALAAPRAPPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 14033 - protein, 827 aa, Artificial Sequence
  Description of Artificial Sequence: Synthetic coding sequence
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLSAFNNILSNLGHVLLGFLFLLIVLRRDILHRRALEAKDIFAVEYGIPKHFGLFYAMGIALMMEGVLSACYHVCPNYSNFQFDTSFMYMIAGLCMLKLYQTRHPDINASAYSAYASFAVVIMVTVLGVVFGKNDVWFWVIFSAIHVLASLALSTQIYYMGRFKIDLGIFRRAAMVFYTDCIQQCSRPLYMDRMVLLVVGNLVNWSFALFGLIYRPRDFASYMLGIFICNLLLYLAFYIIMKLRSSEKVLPVPLFCIVATAVMWAAALYFFFQNLSSWEGTPAESREKNRECILLDFFDDHDIWHFLSATALFFSFLVLLTLDDDLDVVRRDQIPVF

SEQ ID NO: 14034 - protein, 832 aa, Artificial Sequence
  Description of Artificial Sequence: Synthetic coding sequence
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLSAFNNILSNLGHVLLGFLFLLIVLRRDILHRRALEAKDIFAVEYGIPKHFGLFYAMGIALMMEGVLSACYHVCPNYSNFQFDTSFMYMIAGLCMLKLYQTRHPDINASAYSAYASFAVVIMVTVLGVVFGKNDVWFWVIFSAIHVLASLALSTQIYYMGRFKIAITPTDLGIFRRAAMVFYTDCIQQCSRPLYMDRMVLLVVGNLVNWSFALFGLIYRPRDFASYMLGIFICNLLLYLAFYIIMKLRSSEKVLPVPLFCIVATAVMWAAALYFFFQNLSSWEGTPAESREKNRECILLDFFDDHDIWHFLSATALFFSFLVLLTLDDDLDVVRRDQIPVF

SEQ ID NO: 14035 - protein, 855 aa, Artificial Sequence
  Description of Artificial Sequence: Synthetic coding sequence
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGHDQFKRRLPSGQMRQLCIAMGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVSGPPGRAGWVREGSSCLLLCG

SEQ ID NO: 14036 - protein, 832 aa, Artificial Sequence
  Description of Artificial Sequence: Synthetic coding sequence
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 14037 - protein, 186 aa, Artificial Sequence
  Description of Artificial Sequence: Synthetic coding sequence
MFALGLPFLVLLVASVESHLGVLGPKNVSQKDAEFERTYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 14038 - protein, 829 aa, Artificial Sequence
  Description of Artificial Sequence: Synthetic coding sequence
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESASLLGHPRVLADSFPGSSPYEGYNYGSFENVSGSTDGLVDSAGTGDLSYGYQGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 14039 - protein, 109 aa, Artificial Sequence
  Description of Artificial Sequence: Synthetic coding sequence
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLY

SEQ ID NO: 14040 - protein, 110 aa, Artificial Sequence
  Description of Artificial Sequence: Synthetic coding sequence
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQ

SEQ ID NO: 14041 - protein, 2213 aa, Artificial Sequence
  Description of Artificial Sequence: Synthetic coding sequence
MARGARPSAAGGGGGGAEPPERAGPGRPRGSPPGRARPSLAPRPGPEPSRPRAAPETSGGDTAGAGRCGGRRAAKLGPGRRGWWALLALQLHLLRALAQDDVAPYFKTEPGLPQIHLEGNRLVLTCLAEGSWPLEFKWMRDDSELTTYSSEYKYIIPSLQKLDAGFYRCVVRNRMGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEIQTHTYLDVTNIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQVGAIGDEEEWVTLYEEENEPDAQMLEIPNLTPYTHYRFRMKQVNIVGPSPYSPSSRVIQTLQAPPDVAPTSVTVRTASETSLRLRWVPLPDSQYNGNPESVGYRIKYWRSDLQSSAVAQVVSDRLEREFTIEELEEWMEYELQMQAFNAVGAGPWSEVVRGRTRESVPSAAPENVSAEAVSSTQILLTWTSVPEQDQNGLILGYKILFRAKDLDPEPRSHIVRGNHTQSALLAGLRKFVLYELQVLAFTRIGNGVPSTPLILERTKDDAPGPPVRLVFPEVRLTSVRIVWQPPEEPNGIILGYQIAYRLASSSPHTFTTVEVGATVRQFTATDLAPESAYIFRLSAKTRQGWGEPLEATVITTEKRERPAPPRELLVPQAEVTARSLRLQWVPGSDGASPIRYFTMQVRELPRGEWQTYSSSISHEATACVVDRLRPFTSYKLRLKATNDIGDSDFSSETEAVTTLQDVPGEPPGSVSATPHTTSSVLIQWQPPRDESLNGLLQGYRIYYRELEYEAGSGTEAKTLKNPIALHAELTAQSSFKTVNSSSTSTMCELTHLKKYRRYEVIMTAYNIIGESPASAPVEVFVGEAAPAMAPQNVQVTPLTASQLEVTWDPPPPESQNGNIQGYKIYYWEADSQNETEKMKVLFLPEPVVRLKNLTSHTKYLVSISAFNAAGDGPKSDPQQGRTHQAAPGAPSFLAFSEITSTTLNVSWGEPAAANGILQGYRVVYEPLAPVQGVSKVVTVEVRGNWQRWLKVRDLTKGVTYFFRVQARTITYGPELQANITAGPAEGSPGSPRDVLVTKSASELTLQWTEGHSGDTPTTGYVIEARPSDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 14042 - protein, 461 aa, Artificial Sequence
  Description of Artificial Sequence: Synthetic coding sequence
MKVLFLPEPVVRLKNLTSHTKYLVSISAFNAAGDGPKSDPQQGRTHQAAPGAPSFLAFSEITSTTLNVSWGEPAAANGILQGYRVVYEPLAPVQGVSKVVTVEVRGNWQRWLKVRDLTKGVTYFFRVQARTITYGPELQANITAGPAEGSPGSPRDVLVTKSASELTLQWTEGHSGDTPTTGYVIEARPSDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 14043 - protein, 2216 aa, Artificial Sequence
  Description of Artificial Sequence: Synthetic coding sequence
MWGLLIWTLLALHQIRAARAQDDVSPYFKTEPVRTQVHLEGNRLVLTCMAEGSWPLEFKWLHNNRELTKFSLEYRYMITSLDRTHAGFYRCIVRNRMGALLQRQTEVQVAYMGSFEEGEKHQSVSHGEAAVIRAPRIASFPQPQVTWFRDGRKIPPSSRIAITLENTLVILSTVAPDAGRYYVQAVNDKNGDNKTSQPITLTVENVGGPADPIAPTIIIPPKNTSVVAGTSEVTLECVANARPLIKLHIIWKKDGVLLSGGISDHNRRLTIPNPTGSDAGYYECEAVLRSSSVPSVVRGAYLSVLEPPQFVKEPERHITAEMEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVTIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYRPPSKAGVQKEGENRERMCVASSSSALRWWGSLLPWELHGAGEVAVSLLWTRSGAGIWRERGSGG

SEQ ID NO: 14044 - protein, 2153 aa, Artificial Sequence
  Description of Artificial Sequence: Synthetic coding sequence
MWGLLIWTLLALHQIRAARAQDDVSPYFKTEPVRTQVHLEGNRLVLTCMAEGSWPLEFKWLHNNRELTKFSLEYRYMITSLDRTHAGFYRCIVRNRMGALLQRQTEVQVAYMGSFEEGEKHQSVSHGEAAVIRAPRIASFPQPQVTWFRDGRKIPPSSRIAITLENTLVILSTVAPDAGRYYVQAVNDKNGDNKTSQPITLTVENVGGPADPIAPTIIIPPKNTSVVAGTSEVTLECVANARPLIKLHIIWKKDGVLLSGGISDHNRRLTIPNPTGSDAGYYECEAVLRSSSVPSVVRGAYLSVLEPPQFVKEPERHITAEMEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVTIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTYLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYRPPSSLAPGSRAPIAGFSSFV

SEQ ID NO: 14045 - protein, 2172 aa, Artificial Sequence
  Description of Artificial Sequence: Synthetic coding sequence
MWGLLIWTLLALHQIRAARAQDDVSPYFKTEPVRTQVHLEGNRLVLTCMAEGSWPLEFKWLHNNRELTKFSLEYRYMITSLDRTHAGFYRCIVRNRMGALLQRQTEVQVAYMGSFEEGEKHQSVSHGEAAVIRAPRIASFPQPQVTWFRDGRKIPPSSRIAITLENTLVILSTVAPDAGRYYVQAVNDKNGDNKTSQPITLTVENVGGPADPIAPTIIIPPKNTSVVAGTSEVTLECVANARPLIKLHIIWKKDGVLLSGGISDHNRRLTIPNPTGSDAGYYECEAVLRSSSVPSVVRGAYLSVLEPPQFVKEPERHITAEMEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVTIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYRPPSSLAPGSRAPIAGFSSFV

SEQ ID NO: 14046 - protein, 322 aa, Artificial Sequence
  Description of Artificial Sequence: Synthetic coding sequence
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIPLMRQRELKVGIPVTDENGNRLGESANAAKQAITQVVVSRILMAAPGMAIPPFIMNTLEKKAFLKRFPWMSAPIQVGLVGFCLVFATPLCCALFPQKSSMSVTSLEAELQAKIQESHPELRRVYFNKGL

SEQ ID NO: 14047 - protein, 194 aa, Artificial Sequence
  Description of Artificial Sequence: Synthetic coding sequence
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIP

SEQ ID NO: 14048 - protein, 144 aa, Artificial Sequence
  Description of Artificial Sequence: Synthetic coding sequence
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTV

SEQ ID NO: 14049 - protein, 322 aa, Artificial Sequence
  Description of Artificial Sequence: Synthetic coding sequence
MEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRQMALSYFTATTTAVATAVGMNMLTKKAPPLVGRWVPFAAVAAANCVNIPMMRQQELIKGICVKDRNENEIGHSRRAAAIGITQVVISRITMSAPGMILLPVIMERLEKLHFMQKVKVLHAPLQVMLSGCFLIFMVPVACGLFPQKCELPVSYLEPKLQDTIKAKYGELEPYVYFNKGL

SEQ ID NO: 14050 - protein, 325 aa, Artificial Sequence
  Description of Artificial Sequence: Synthetic coding sequence
MESKMGELPLDINIQEPRWDQSTFLGRARHFFTVTDPRNLLLSGAQLEASRNIVQNYRAGVVTPGITEDQLWRAKYVYDSAFHPDTGEKVVLIGRMSAQVPMNMTITGCMLTFYRKTPTVVFWQWVNQSFNAIVNYSNRSGDTPITVRQLGTAYVSATTGAVATALGLKSLTKHLPPLVGRFVPFAAVAAANCINIPLMRQRELQVGIPVADEAGQRLGYSVTAAKQGIFQVVISRICMAIPAMAIPPLIMDTLEKKDFLKRRPWLGAPLQVGLVGFCLVFATPLCCALFPQKSSIHISNLEPELRAQIHEQNPSVEVVYYNKGL

SEQ ID NO: 14051 - protein, 321 aa, Artificial Sequence
  Description of Artificial Sequence: Synthetic coding sequence
MGELPLDINIQEPRWDQSTFLGRARHFFTVTDPRNLLLSGAQLEASRNIVQNYRAGVVTPGITEDQLWRAKYVYDSAFHPDTGEKVVLIGRMSAQVPMNMTITGCMLTFYRKTPTVVFWQWVNQSFNAIVNYSNRSGDTPITVRQLGTAYVSATTGAVATALGLKSLTKHLPPLVGRFVPFAAVAAANCINIPLMRQRELQVGIPVADEAGQRLGYSVTAAKQGIFQVVISRICMAIPAMAIPPLIMDTLEKKDFLKRRPWLGAPLQVGLVGFCLVFATPLCCALFPQKSSIHISNLEPELRAQIHEQNPSVEVVYYNKGL

SEQ ID NO: 14052 - protein, 328 aa, Artificial Sequence
  Description of Artificial Sequence: Synthetic coding sequence
MSLEQEEETQPGRLLGRRDAVPAFIEPNVRFWITERQSFIRRFLQWTELLDPTNVFISVESIENSRQLLCTNEDVSSPASADQRATVHPDSSNLIPKLFRPAAFLPFMAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQIQYCSLEEKIQSPTEETEIFYHRGV

SEQ ID NO: 14053 - protein, 337 aa, Artificial Sequence
  Description of Artificial Sequence: Synthetic coding sequence
MSLEQEEETQPGRLLGRRDAVPAFIEPNVRFWITERQSFIRRFLQWTELLDPTNVFISVESIENSRQLLCTNEDVSSPASADQRIQEAWKRSLATVHPDSSNLIPKLFRPAAFLPFMAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQIQYCSLEEKIQSPTEETEIFYHRGV

SEQ ID NO: 14054 - protein, 178 aa, Artificial Sequence
  Description of Artificial Sequence: Synthetic coding sequence
MAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVL

SEQ ID NO: 14055 - protein, 220 aa, Artificial Sequence
  Description of Artificial Sequence: Synthetic coding sequence
SPLVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQIQYCSLEEKIQSPTEETEIFYHRGV

SEQ ID NO: 14056 - protein, 63 aa, Artificial Sequence
  Description of Artificial Sequence: Synthetic coding sequence
MAPTVFLSMTPLKGIKSVILPQVFLCAYMAAFNSINGNRSYTCKPLERSLLMAGAVASSTFLG

SEQ ID NO: 14057 - protein, 340 aa, Artificial Sequence
  Description of Artificial Sequence: Synthetic coding sequence
MADTATTASAAAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVASANICNVVLMRYGELEEGIDVLDSDGNLVGSSKIAARHALLETALTRVVLPMPILVLPPIVMSMLEKTALLQARPRLLLPVQSLVCLAAFGLALPLAISLFPQMSEIETSQLEPEIAQATSSRTVVYNKGL

SEQ ID NO: 14058 - protein, 169 aa, Artificial Sequence
  Description of Artificial Sequence: Synthetic coding sequence
MARGGDTGCTGPSETSASGAAAIALPGLEGPATDAQCQTLPLTVLKSRSPSPRSLPPALSCPPPQPAMLEHLSSLPTQMDYKGQKLAEQMFQGIILFSAIVGFIYGYVAEQFGWTVYIVMAGFAFSCLLTLPPWPIYRRHPLKWLPVQESSTDDKKPGERKIKRHAKNN

SEQ ID NO: 14059 - protein, 226 aa, Artificial Sequence
  Description of Artificial Sequence: Synthetic coding sequence
MAAAAVQGGRSGGSGGCSGAGGASNCGTGSGRSGLLDKWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 14060 - protein, 180 aa, Artificial Sequence
  Description of Artificial Sequence: Synthetic coding sequence
MNTVLSRANSLFAFSLSVMAALTFGCFITTAFKDRSVPVRLHVSRIMLKNVEDFTGPRERSDLGFITFDITADLENIFDWNVKQLFLYLSAEYSTKNNALNQVVLWDKIVLRGDNPKLLLKDMKTKYFFFDDGNGLKGNRNVTLTLSWNVVPNAGILPLVTGSGHVSVPFPDTYEITKSY

SEQ ID NO: 14061 - protein, 520 aa, Artificial Sequence
  Description of Artificial Sequence: Synthetic coding sequence
MGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELENLKAVTTEDREMRKKKEEYLTFSPLTVVIFVVICCVMMVLLYFFYKWLVYVMIAIFCIASAMSLYNCLAALIHKIPYGQCTIACRGKNMEVRLIFLSGLCIAVAVVWAVFRNEDRWAWILQDILGIAFCLNLIKTLKLPNFKSCVILLGLLLLYDVFFVFITPFITKNGESIMVELAAGPFGNNEKLPVVIRVPKLIYFSVMSVCLMPVSILGFGDIIVPGLLIAYCRRFDVQTGSSYIYYVSSTVAYAIGMILTFVVLVLMKKGQPALLYLVPCTLITASVVAWRRKEMKKFWKGNSYQMMDHLDCATNEENPVISGEQIVQQ

SEQ ID NO: 14062 - protein, 684 aa, Artificial Sequence
  Description of Artificial Sequence: Synthetic coding sequence
MACLGFLLPVGFLLLISTVAGGKYGVAHVVSENWSKDYCILFSSDYITLPRDLHHAPLLPLYDGTKAPWCPGEDSPHQAQLRSPSQRPLRQTTAMVMRGNCSFHTKGWLAQGQGAHGLLIVSRVSDQQCSDTTLAPQDPRQPLADLTIPVAMLHYADMLDILSHTRGEAVVRVAMYAPPEPIIDYNMLVIFILAVGTVAAGGYWAGLTEANRLQRRRARRGGGSGGHHQLQEAAAAEGAQKEDNEDIPVDFTPAMTGVVVTLSCSLMLLLYFFYDHFVYVTIGIFGLGAGIGLYSCLSPLVCRLSLRQYQRPPHSLWASLPLPLLLLASLCATVIIFWVAYRNEDRWAWLLQDTLGISYCLFVLHRVRLPTLKNCSSFLLALLAFDVFFVFVTPFFTKTGESIMAQVALGPAESSSHERLPMVLKVPRLRVSALTLCSQPFSILGFGDIVVPGFLVAYCCRFDVQVCSRQIYFVACTVAYAVGLLVTFMAMVLMQMGQPALLYLVSSTLLTSLAVAACRQELSLFWTGQGRAKMCGLGCAPSAGSRQKQEGAADAHTASTLERGTSRGAGDLDSNPGEDTTEIVTISENEATNPEDRSDSSEGWSDAHLDPNELPFIPPGASEELMPLMPMAMLIPLMPLMPPPSELGHVHAQAQAHETGLPWAGLHKRKGLKVRKSMSTQAPL

SEQ ID NO: 14063 - protein, 384 aa, Artificial Sequence
  Description of Artificial Sequence: Synthetic coding sequence
MAEQTYSWAYSLVDSSQVSTFLISILLIVYGSFRSLNMDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKVSCLLLSGLLIYDVFWVFFSAYIFNSNVMVKVATQPADNPLDVLSRKLHLGPNVGRDVPRLSLPGKLVFPSSTGSHFSMLGIGDIVMPGLLLCFVLRYDNYKKQASGDSCGAPGPANISGRMQKVSYFHCTLIGYFVGLLTATVASRIHRAAQPALLYLVPFTLLPLLTMAYLKGDLRRMWSEPFHSKSSSSRFLEV

SEQ ID NO: 14064 - protein, 383 aa, Artificial Sequence
  Description of Artificial Sequence: Synthetic coding sequence
SIRTHCMAYSLVDSSQVSTFLISILLIVYGSFRSLNMDFENQDKEKDSNSSSGSFNGNSPIIGIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKVSCLLLSGLLIYDVFWVFFSAYIFNSNVMVKVATQPADNPLDVLSRKLHLGPNVGRDVPRLSLPGKLVFPSSTGSHFSMLGIGDIVMPGLLLCFVLRYDNYKKQASGDSCGAPGPANISGRMQKVSYFHCTLIGYFVGLLTATVASRIHRAAQPALLYLVPFTLLPLLTMAYLKGDLRRMWSEPFHSKSSSSRFLEV

SEQ ID NO: 14065 - protein, 271 aa, Artificial Sequence
  Description of Artificial Sequence: Synthetic coding sequence
MASADSRRVADGGGAGGTFQPYLDTLRQELQQTDPTLLSVVVAVLAVLLTLVFWKLIRSRRSSQRAVLLVGLCDSGKTLLFVRLLTGLYRDTQTSITDSCAVYRVNNNRGNSLTLIDLPGHESLRLQFLERFKSSARAIVFVVDSAAFQREVKDVAEFLYQVLIDSMGLKNTPSFLIACNKQDIAMAKSAKLIQQQLEKELNTLRVTRSAAPSTLDSSSTAPAQLGKKGKEFEFSQLPLKVEFLECSAKGGRGDVGSADIQDLEKWLAKIA

SEQ ID NO: 14066 - protein, 92 aa, Artificial Sequence
  Description of Artificial Sequence: Synthetic coding sequence
MASADSRRVADGGGAGGTFQPYLDTLRQELQQTDPTLLSVVVAVLAVLLTLVFWKLIRSRRSSQRAVLLVGLCDSGKTLLFVRLLTGLYRDT

SEQ ID NO: 14067 - protein, 286 aa, Artificial Sequence
  Description of Artificial Sequence: Synthetic coding sequence
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQINKASPRRLPRKRAQKRSVGSDE

SEQ ID NO: 14068 - protein, 259 aa, Artificial Sequence
  Description of Artificial Sequence: Synthetic coding sequence
MRLLPRLLLLLLLVFPATVLFRGGPRGLLAVAQDLTEDEETVEDSIIEDEDDEAEVEEDEPTDLVKYFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQINKASPRRLPRKRAQKRSVGSDE

SEQ ID NO: 14069 - protein, 185 aa, Artificial Sequence
  Description of Artificial Sequence: Synthetic coding sequence
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 14070 - protein, 198 aa, Artificial Sequence
  Description of Artificial Sequence: Synthetic coding sequence
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERFDSCLKYGHHKRGILWKKNEVADYEATTFSIFYNNTLFLVVVIVASFFILKNFNPTVNYILSISASSGLIALLSTGSK

SEQ ID NO: 14071 - protein, 1783 aa, Artificial Sequence
  Description of Artificial Sequence: Synthetic coding sequence
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSSKDSSPTLASKVDQLEGMLKMLREDLKKEKEDKAHLQAEVQHLREDNLRLQEESQNASDKLKKFTEWVFNTIDMS

SEQ ID NO: 14072 - protein, 1257 aa, Artificial Sequence
  Description of Artificial Sequence: Synthetic coding sequence
MKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSKDSSPTLASKVDQLEGMLKMLREDLKKEKEDKAHLQAEVQHLREDNLRLQEESQNASDKLKKFTEWVFNTIDMS

SEQ ID NO: 14073 - protein, 1804 aa, Artificial Sequence
  Description of Artificial Sequence: Synthetic coding sequence
MTSLKRSQTERPLATDRASVVGTDGTPKVHTDDFYMRRFRSQNGSLGSSVMAPVGPPRSEGSHHITSTPGVPKMGVRARIADWPPRKENIKESSRSSQEIETSSCLDSLSSKSSPVSQGSSVSLNSNDSAMLKSIQNTLKNKTRPSENMDSRFLMPEAYPSSPRKALRRIRQRSNSDITISELDVDSFDECISPTYKTGPSLHREYGSTSSIDKQGTSGESFFDLLKGYKDDKSDRGPTPTKLSDFLITGGGKGSGFSLDVIDGPISQRENLRLFKEREKPLKRRSKSETGDSSIFRKLRNAKGEELGKSSDLEDNRSEDSVRPWTCPKCFAHYDVQSILFDLNEAIMNRHNVIKRRNTTTGASAAAVASLVSGPLSHSASFSSPMGSTEDLNSKGSLSMDQGDDKSNELVMSCPYFRNEIGGEGERKISLSKSNSGSFSGCESASFESTLSSHCTNAGVAVLEVPKENLVLHLDRVKRYIVEHVDLGAYYYRKFFYQKEHWNYFGADENLGPVAVSIRREKPDEMKENGSPYNYRIIFRTSELMTLRGSVLEDAIPSTAKHSTARGLPLKEVLEHVVPELNVQCLRLAFNTPKVTEQLMKLDEQGLNYQQKVGIMYCKAGQSTEEEMYNNESAGPAFEEFLQLLGERVRLKGFEKYRAQLDTKTDSTGTHSLYTTYKDYEIMFHVSTMLPYTPNNKQQLLRKRHIGNDIVTIVFQEPGAQPFSPKNIRSHFQHVFVIVRVHNPCSDSVCYSVAVTRSRDVPSFGPPIPKGVTFPKSNVFRDFLLAKVINAENAAHKSEKFRAMATRTRQEYLKDLAEKNVTNTPIDPSGKFPFISLASKKKEKSKPYPGAELSSMGAIVWAVRAEDYNKAMELDCLLGISNEFIVLIEQETKSVVFNCSCRDVIGWTSTDTSLKIFYERGECVSVGSFINIEEIKEIVKRLQFVSKGCESVEMTLRRNGLGQLGFHVNYEGIVADVEPYGYAWQAGLRQGSRLVEICKVAVATLSHEQMIDLLRTSVTVKVVIIPPHDDCTPRRSCSETYRMPVMEYKMNEGVSYEFKFPFRNNNKWQRNASKGPHSPQVPSQVQSPMTSRLNAGKGDGKMPPPERAANIPRSISSDGRPLERRLSPGSDIYVTVSSMALARSQCRNSPSNLSSSSDTGSVGGTYRQKSMPEGFGVSRRSPASIDRQNTQSDIGGSGKSTPSWQRSEDSIADQMAYSYRGPQDFNSFVLEQHEYTEPTCHLPAVSKVLPAFRESPSGRLMRQDPVVHLSPNKQGHSDSHYSSHSSSNTLSSNASSAHSDEKWYDGDRTESELNSYNYLQGTSADSGIDTTSYGPSHGSTASLGAATSSPRSGPGKEKVAPLWHSSSEVISMADRTLETESHGLDRKTESSLSLDIHSKSQAGSTPLTRENSTFSINDAASHTSTMSSRHSASPVVFTSARSSPKEELHPAAPSQLAPSFSSSSSSSSGPRSFYPRQGATSKYLIGWKKPEGTINSVGFMDTRKRHQSDGNEIAHTRLRASTRDLRASPKPTSKSTIEEDLKKLIDLESPTPESQKSFKFHALSSPQSPFPSTPTSRRALHRTLSDESIYNSQREHFFTSRASLLDQALPNDVLFSSTYPSLPKSLPLRRPSYTLGMKSLHGEFSASDSSLTDIQETRRQPMPDPGLMPLPDTAADLDWSNLVDAAKAYEVQRASFFAASDENHRPLSAASNSDQLEDQALAQMKPYSSSKDSSPTLASKVDQLEGMLKMLREDLKKEKEDKAHLQAEVQHLREDNLRLQEESQNASDKLKKFTEWVFNTIDMS

SEQ ID NO: 14074 - protein, 196 aa, Artificial Sequence
  Description of Artificial Sequence: Synthetic coding sequence
MNQADPRLRAVCLWTLTSAAMSRGDNCTDLLALGIPSITQAWGLWVLLGAVTLLFLISLAAHLSQWTRGRSRSHPGQGRSGESVEEVPLYGNLHYLQTGRLSQDPEPDQQDPTLGGPARAAEEVMCYTSLQLRPPQGRIPGPGTPVKYSEVVLDSEPKSQASGPEPELYASVCAQTRRARASFPDQAYANSQPAAS

SEQ ID NO: 14075 - protein, 504 aa, Artificial Sequence
  Description of Artificial Sequence: Synthetic coding sequence
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 14076 - protein, 504 aa, Artificial Sequence; identical to SEQ ID NO: 14075
  Description of Artificial Sequence: Synthetic coding sequence

SEQ ID NO: 14077 - protein, 508 aa, Artificial Sequence
  Description of Artificial Sequence: Synthetic coding sequence
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQVQSLDTNDITYADLNLPKGKKPAPQAAEPNNHTEYASIQTSPQPASEDTLTYADLDMVHLNRTPKQPAPKPEPSFSEYASVQVPRK

SEQ ID NO: 14078 - protein, 180 aa, Artificial Sequence
  Description of Artificial Sequence: Synthetic coding sequence
MPVPASWPHPPCPFLLLTLLLGLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVREAALAPTAPLLVALLLGPKLLLVVGVSAIYICWKQKA

SEQ ID NO: 14079 - protein, 398 aa, Artificial Sequence
  Description of Artificial Sequence: Synthetic coding sequence
MPVPASWPHLPSPFLLMTLLLGRLTGVAGEEELQVIQPDKSISVAAGESATLHCTVTSLIPVGPIQWFRGAGPGRELIYNQKEGHFPRVTTVSDLTKRNNMDFSIRISNITPADAGTYYCVKFRKGSPDHVEFKSGAGTELSVRAKPSAPVVSGPAARATPQHTVSFTCESHGFSPRDITLKWFKNGNELSDFQTNVDPAGDSVSYSIHSTAKVVLTREDVHSQVICEVAHVTLQGDPLRGTANLSETIRVPPTLEVTQQPVRAENQVNVTCQVRKFYPQRLQLTWLENGNVSRTETASTLTENKDGTYNWMSWLLVNVSAHRDDVKLTCQVEHDGQPAVSKSHDLKVSAHPKEQGSNTAPGPALASAAPLLIAFLLGPKVLLVVGVSVIYVYWKQKA

SEQ ID NO: 14080 - protein, 172 aa, Artificial Sequence
  Description of Artificial Sequence: Synthetic coding sequence
MPVPASWPHLPSPFLLMTLLLGRLTGVAGEEELQVIQPDKSISVAAGESATLHCTVTSLIPVGPIQWFRGAGPGRELIYNQKEGHFPRVTTVSDLTKRNNMDFSIRISNITPADAGTYYCVKFRKGSPDHVEFKSGAGTELSVRVLQVKEIKIPRTLASVVIQVYLLQHPVA

SEQ ID NO: 14081 - protein, 181 aa, Artificial Sequence
  Description of Artificial Sequence: Synthetic coding sequence
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVREAALAPTAPLLVALLLGPKLLLVVGVSAIYICWKQKA

SEQ ID NO: 14082 - protein, 398 aa, Artificial Sequence
  Description of Artificial Sequence: Synthetic coding sequence
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVRAKPSAPVVSGPAVRATPEHTVSFTCESHGFSPRDITLKWFKNGNELSDFQTNVDPAGDSVSYSIHSTARVVLTRGDVHSQVICEIAHITLQGDPLRGTANLSEAIRVPPTLEVTQQPMRAENQANVTCQVSNFYPRGLQLTWLENGNVSRTETASTLIENKDGTYNWMSWLLVNTCAHRDDVVLTCQVEHDGQQAVSKSYALEISAHQKEHGSDITHEAALAPTAPLLVALLLGPKLLLVVGVSAIYICWKQKA

SEQ ID NO: 14083 - protein, 172 aa, Artificial Sequence
  Description of Artificial Sequence: Synthetic coding sequence
MLAAGVGGQGERLAGRRRKMAVESRVTQEEIKKEPEKPIDREKTCPLLLRVFTTNNGRHHRMDEFSRGNVPSSELQIYTWMDATLKELTSLVKEVYPEARKKGTHFNFAIVFTDVKRPGYRVKEIGSTMSGRKGTDDSMTLQSQKFQIGDYLDIAITPPNRAPPPSGRMRPY

SEQ ID NO: 14084 - protein, 339 aa, Artificial Sequence
  Description of Artificial Sequence: Synthetic coding sequence
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 14085 - protein, 198 aa, Artificial Sequence
  Description of Artificial Sequence: Synthetic coding sequence
MCAFPWLLLLLLLQEGSQRRLWRWCGSEEVVAVLQESISLPLEIPPDEEVENIIWSSHKSLATVVPGKEGHPATIMVTNPHYQGQVSFLDPSYSLHISNLSWEDSGLYQAQVNLRTSQISTMQQYNICVYHPNYASEKPSTAFCLLAKGLLIFLLLVILAMGLWVIRVQKRHKMPRMKKLMRNRMKLRKEAKPGSSPA

SEQ ID NO: 14086 - protein, 289 aa, Artificial Sequence
  Description of Artificial Sequence: Synthetic coding sequence
MCAFPWLLLLLLLQEGSQRRLWRWCGSEEVVAVLQESISLPLEIPPDEEVENIIWSSHKSLATVVPGKEGHPATIMVTNPHYQGQVSFLDPSYSLHISNLSWEDSGLYQAQVNLRTSQISTMQQYNICVYRWLSEPQITVNFESSGEGACSMSLVCSVEKAGMDMTYSWLSRGDSTYTFHEGPVLSTSWRPGDSALSYTCRANNPISNVSSCPIPDGPFYADPNYASEKPSTAFCLLAKGLLIFLLLVILAMGLWVIRVQKRHKMPRMKKLMRNRMKLRKEAKPGSSPA

SEQ ID NO: 14087 - protein, 172 aa, Artificial Sequence
  Description of Artificial Sequence: Synthetic coding sequence
MKIWSSEHVFGHPWDTVIQAAMRKYPNPMNPSVLGVDVLQRRVDGRGRLHSLRLLSTEWGLPSLVRAILGTSRTLTYIREHSVVDPVEKKMELCSTNITLTNLVSVNERLVYTPHPENPEMTVLTQEAIITVKGISLGSYLESLMANTISSNAKKGWAAIEWIIEHSESAVS

SEQ ID NO: 14088 - protein, 172 aa, Artificial Sequence; identical to SEQ ID NO: 14087
  Description of Artificial Sequence: Synthetic coding sequence

SEQ ID NO: 14089 - protein, 194 aa, Artificial Sequence
  Description of Artificial Sequence: Synthetic coding sequence
MKIWTSEHVFDHPWETVTTAAMQKYPNPMNPSVVGVDVLDRHIDPSGKLHSHRLLSTEWGLPSIVKSLIGAARTKTYVQEHSVVDPVEKTMELKSTNISFTNMVSVDERLIYKPHPQDPEKTVLTQEAIITVKGVSLSSYLEGLMASTISSNASKGREAMEWVIHKLNAEIEELTASARGTIRTPMAAAAFAEK

SEQ ID NO: 14090 - protein, 748 aa, Artificial Sequence
  Description of Artificial Sequence: Synthetic coding sequence
MSNPGGRRNGPVKLRLTVLCAKNLVKKDFFRLPDPFAKVVVDGSGQCHSTDTVKNTLDPKWNQHYDLYIGKSDSVTISVWNHKKIHKKQGAGFLGCVRLLSNAINRLKDTGYQRLDLCKLGPNDNDTVRGQIVVSLQSRDRIGTGGQVVDCSRLFDNDLPDGWEERRTASGRIQYLNHITRTTQWERPTRPASEYSSPGRPLSCFVDENTPISGTNGATCGQSSDPRLAERRVRSQRHRNYMSRTHLHTPPDLPEGYEQRTTQQGQVYFLHTQTGVSTWHDPRVPRDLSNINCEELGPLPPGWEIRNTATGRVYFVDHNNRTTQFTDPRLSANLHLVLNRQNQLKDQQQQQVVSLCPDDTECLTVPRYKRDLVQKLKILRQELSQQQPQAGHCRIEVSREEIFEESYRQVMKMRPKDLWKRLMIKFRGEEGLDYGGVAREWLYLLSHEMLNPYYGLFQYSRDDIYTLQINPDSAVNPEHLSYFHFVGRIMGMAVFHGHYIDGGFTLPFYKQLLGKSITLDDMELVDPDLHNSLVWILENDITGVLDHTFCVEHNAYGEIIQHELKPNGKSIPVNEENKKEYVRLYVNWRFLRGIEAQFLALQKGFNEVIPQHLLKTFDEKELELIICGLGKIDVNDWKVNTRLKHCTPDSNIVKWFWKAVEFFDEERRARLLQFVTGSSRVPLQGFKALQGAAGPRLFTIHQIDACTNNLPKAHTCFNRIDIPPYESYEKLYEKLLTAIEETCGFAVE

SEQ ID NO: 14091 - protein, 97 aa, Artificial Sequence
  Description of Artificial Sequence: Synthetic coding sequence
MTSLLTTPSPREELMTTPILQPTEALSPEDGASTALIAVVITVVFLTLLSVVILIFFYLYKNKGSYVTYEPTEGEPSAIVQMESDLAKGSEKEEYFI

SEQ ID NO: 14092 - protein, 97 aa, Artificial Sequence; identical to SEQ ID NO: 14091
  Description of Artificial Sequence: Synthetic coding sequence

SEQ ID NO: 14093 - protein, 1093 aa, Artificial Sequence
  Description of Artificial Sequence: Synthetic coding sequence
MASAPAEAETRQRLLRTVKKEVKQIMEEAVTRKFVHEDSSHIISFCAAVEACVLHGLRRRAAGFLRSNKIAALFMKVGKNFPPAEDLSRKVQDLEQLIESARNQIQGLQENVRKLPKLPNLSPLAIKHLWIRTALFEKVLDKIVHYLVENSSKYYEKEALLMDPVDGPILASLLVGPCALEYTKMKTADHFWTDPSADELVQRHRIHSSHVRQDSPTKRPALCIQKRHSSGSMDDRPSLSARDYVESLHQNSRATLLYGKNNVLVQPRDDMEAVPGYLSLHQTADVMTLKWTPNQLMNGSVGDLDYEKSVYWDYAMTIRLEEIVYLHCHQQVDSGGTVVLVSQDGIQRPPFRFPKGGHLLQFLSCLENGLLPHGQLDPPLWSQRGKGKVFPKLRKRSPQGSAESTSSDKDDDEATDYVFRIIYPGMQSEFVPQDLMDVSVSNLPSLWQPSPRKSSCSSCSQSGSADGSSTNGCNHERAPLKLLCDNMKYQILSRAFYGWLAYCRHLSTVRTHLSALVNHMIVSPDLPCDAGQGLTARIWEQYLHDSTSYEEQELLRLIYYGGIQPEIRKAVWPFLLGHYQFGMTETERKEVDEQIHACYAQTMAEWLGCEAIVRQRERESHAAALAKCSSGASLDSHLHRMLHRDSTISNESSQSCSSGRQNIRLHSDSSSSTQVFESVDEVEQVEAEGRLEEKQPKIPNGNLVNGTCSPDSGHPSSHNFSSGLSEHSEPSLSTEDSVLDAQRNTPTVLRPRDGSVDDRQSSEATTSQDEAPREELAVQDSLESDLLANESMDEFMSITGSLDMALPEKDDVVMEGWRSSETEKHGQADSEDNLSEEPEMESLFPALASLAVTTSANEVSPVSSSGVTYSPELLDLYTVNLHRIEKDVQRCDRNYWYFTPANLEKLRNIMCSYIWQHIEIGYVQGMCDLLAPLLVILDDEALAFSCFTELMKRMNQNFPHGGAMDTHFANMRSLIQILDSELFELMHQNGDYTHFYFCYRWFLLDFKRELVYDDVFLVWETIWAAKHVSSAHYVLFIALALVEVYRDIILENNMDFTDIIKFFNEMAERHNTKQVLKLARDLVYKVQTLIENK

SEQ ID NO: 14094 - protein, 1148 aa, Artificial Sequence
  Description of Artificial Sequence: Synthetic coding sequence
MASAPAEAETRQRLLRTVKKEVKQIMEEAVTRKFVHEDSSHIISFCAAVEACVLHGLRRRAAGFLRSNKIAALFMKVGKNFPPAEDLSRKVQDLEQLIESARNQIQGLQENVRKLPKLPNLSPLAIKHLWIRTALFEKVLDKIVHYLVENSSKYYEKEALLMDPVDGPILASLLVGPCALEYTKMKTADHFWTDPSADELVQRHRIHSSHVRQDSPTKRPALCIQKRHSSGSMDDRPSLSARDYVESLHQNSRATLLYGKNNVLVQPRDDMEAVPGYLSLHQTADVMTLKWTPNQLMNGSVGDLDYEKSVYWDYAMTIRLEEIVYLHCHQQVDSGGTVVLVSQDGIQRPPFRFPKGGHLLQFLSCLENGLLPHGQLDPPLWSQRGKGKVFPKLRKRSPQGSAESTSSDKDDDEATDYVFRIIYPGMQSEFVAPDFLGSTSSVSVGPAWMMVPAGRSMLVVARGSQWEPARWDTTLPTPSPKEQPPMPQDLMDVSVSNLPSLWQPSPRKSSCSSCSQSGSADGSSTNGCNHERAPLKLLCDNMKYQILSRAFYGWLAYCRHLSTVRTHLSALVNHMIVSPDLPCDAGQGLTARIWEQYLHDSTSYEEQELLRLIYYGGIQPEIRKAVWPFLLGHYQFGMTETERKEVDEQIHACYAQTMAEWLGCEAIVRQRERESHAAALAKCSSGASLDSHLHRMLHRDSTISNESSQSCSSGRQNIRLHSDSSSSTQVFESVDEVEQVEAEGRLEEKQPKIPNGNLVNGTCSPDSGHPSSHNFSSGLSEHSEPSLSTEDSVLDAQRNTPTVLRPRDGSVDDRQSSEATTSQDEAPREELAVQDSLESDLLANESMDEFMSITGSLDMALPEKDDVVMEGWRSSETEKHGQADSEDNLSEEPEMESLFPALASLAVTTSANEVSPVSSSGVTYSPELLDLYTVNLHRIEKDVQRCDRNYWYFTPANLEKLRNIMCSYIWQHIEIGYVQGMCDLLAPLLVILDDEALAFSCFTELMKRMNQNFPHGGAMDTHFANMRSLIQILDSELFELMHQNGDYTHFYFCYRWFLLDFKRELVYDDVFLVWETIWAAKHVSSAHYVLFIALALVEVYRDIILENNMDFTDIIKFFNEMAERHNTKQVLKLARDLVYKVQTLIENK

SEQ ID NO: 14095 - protein, 1148 aa, Artificial Sequence
  Description of Artificial Sequence: Synthetic coding sequence
MEEAVTRKFVHEDSSHIISFCAAVEACVLHGLRRRAAGFLRSNKIAALFMKVGKNFPPAEDLSRKVQDLEQLIESARNQIQGLQENVRKLPKLPNLSPLAIKHLWIRTALFEKVLDKIVHYLVENSSKYYEKEALLMDPVDGPILASLLVGPCALEYTKMKTADHFWTDPSADELVQRHRIHSSHVRQDSPTKRPALCIQKRHSSGSMDDRPSLSARDYVESLHQNSRATLLYGKNNVLVQPGLTPGYRGKGLSGSRLPIHSSIYALTHAHIHPPNTHSSIHLYLHAPILTSIHPPIVISIHPPIVTTIHPSTHLYIHLSNHLYIHPSTHLYIHPSTHLYIYPSIHPSIHPSIYPSIHFSDYVFLNQTGQTYVHSNSSTMARPEDDMEAVPGYLSLHQTADVMTLKWTPNQLMNGSVGDLDYEKSVYWDYAMTIRLEEIVYLHCHQQVDSGGTVVLVSQDGIQRPPFRFPKGGHLLQFLSCLENGLLPHGQLDPPLWSQRGKGKVFPKLRKRSPQGSAESTSSDKDDDEATDYVFRIIYPGMQSEFVPQDLMDVSVSNLPSLWQPSPRKSSCSSCSQSGSADGSSTNGCNHERAPLKLLCDNMKYQILSRAFYGWLAYCRHLSTVRTHLSALVNHMIVSPDLPCDAGQGLTARIWEQYLHDSTSYEEQELLRLIYYGGIQPEIRKAVWPFLLGHYQFGMTETERKESSQSCSSGRQNIRLHSDSSSSTQVFESVDEVEQVEAEGRLEEKQPKIPNGNLVNGTCSPDSGHPSSHNFSSGLSEHSEPSLSTEDSVLDAQRNTPTVLRPRDGSVDDRQSSEATTSQDEAPREELAVQDSLESDLLANESMDEFMSITGSLDMALPEKDDVVMEGWRSSETEKHGQADSEDNLSEEPEMESLFPALASLAVTTSANEVSPVSSSGVTYSPELLDLYTVNLHRIEKDVQRCDRNYWYFTPANLEKLRNIMCSYIWQHIEIGYVQGMCDLLAPLLVILDDEALAFSCFTELMKRMNQNFPHGGAMDTHFANMRSLIQILDSELFELMHQNGDYTHFYFCYRWFLLDFKRELVYDDVFLVWETIWAAKHVSSAHYVLFIALALVEVYRDIILENNMDFTDIIKFFNEMAERHNTKQVLKLARDLVYKVQTLIENK

SEQ ID NO: 14096 - protein, 77 aa, Artificial Sequence
  Description of Artificial Sequence: Synthetic coding sequence
MGLCFPCPGESAPPTPDLEEKRAKLAEAAERRQKEAASRGILDVQSVQEKRKKKEKIEKQIATSGPPPEGGLRWTVS

SEQ ID NO: 14097 - protein, 454 aa, Artificial Sequence
  Description of Artificial Sequence: Synthetic coding sequence
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPEGPAETDPEVTPQLSSPAPLCLTLQERLLAFERDRVTIPAAQVALAKQLAGDIALELQAYFRSKFPELPFGAFVPGGPLYDGLQAGAADHVRLLVPLVLEPGLWSLVPGVDTVARDPRCWAVRRTQLEFCPRGSSPWDRFLVGGYLSSRVLLELLRKALAASVNWPAIGSLLGCLIRPSMASEELLLEVQHERLELTVAVLVAVPGVDADDRLLLAWPLEGLAGNLWLQDLYPVEAARLRALDDHDAGTRRRLLLLLCAVCRGCSALGQLGRGHLTQVVLRLGEDNVDWTEEALGERFLQALELLIGSLEQASLPCHFNPSVNLFSSLREEEIDDIGYALYSGLQEPEGLL

SEQ ID NO: 14098 - protein, 163 aa, Artificial Sequence
  Description of Artificial Sequence: Synthetic coding sequence
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPGEWHSFPSFGVTFKRRSPGFALTDCVTLRESLLLSRLWAPQIFNGGGVSLPCSWSKVVAL

SEQ ID NO: 14099 - protein, 205 aa, Artificial Sequence
  Description of Artificial Sequence: Synthetic coding sequence
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPGEAAGLRAGPCDHPSSPGGFGQTAGWRHRPGAAGLLSEQVPGTALWGIRAWGAALRRAAGGGCGPCASPGATGAGAGPVEPGAGRGHCGEGPSLLGRAQDAA

SEQ ID NO: 14100 - protein, 465 aa, Artificial Sequence
  Description of Artificial Sequence: Synthetic coding sequence
MGLSPNLDRQTMAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPEGPAETDPEVTPQLSSPAPLCLTLQERLLAFERDRVTIPAAQVALAKQLAGDIALELQAYFRSKFPELPFGAFVPGGPLYDGLQAGAADHVRLLVPLVLEPGLWSLVPGVDTVARDPRCWAVRRTQLEFCPRGSSPWDRFLVGGYLSSRVLLELLRKALAASVNWPAIGSLLGCLIRPSMASEELLLEVQHERLELTVAVLVAVPGVDADDRLLLAWPLEGLAGNLWLQDLYPVEAARLRALDDHDAGTRRRLLLLLCAVCRGCSALGQLGRGHLTQVVLRLGEDNVDWTEEALGERFLQALELLIGSLEQASLPCHFNPSVNLFSSLREEEIDDIGYALYSGLQEPEGLL

SEQ ID NO: 14101 - protein, 463 aa, Artificial Sequence
  Description of Artificial Sequence: Synthetic coding sequence
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTDTFCPPRPKPVARKGQVDLKKSRLRMSLQEKLLTYYRNRAAIPAGEQARAKQAAVDICAELRSFLRAKLPDMPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPEALTLEVQYERDKHLFIDFLPSVTLGDTVLVAKPHRLAQYDNLWRLSLRPAETARLRALDQADSGCRSLCLKILKAICKSTPALGHLTASQLTNVILHLAQEEADWSPDMLADRFLQALRGLISYLEAGVLPSALNPKVNLFAELTPEEIDELGYTLYCSLSEPEVLLQT

SEQ ID NO: 14102 - protein, 478 aa, Artificial Sequence
  Description of Artificial Sequence: Synthetic coding sequence
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTDTFCPPRPKPVARKGQVDLKKSRLRMSLQEKLLTYYRNRAAIPAGEQARAKQAAVDICAELRSFLRAKLPDMPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPEALTLEVQYERDKHLFIDFLPSVTLGDTVLVAKPHRLAQYDNLWRLSLRPAETARLRALDQADSGCRSLCLKILKAICKSTPALGHLTASQLTNVILHLAQEEADWSPDMLADRFLQALRGLISYLEAGVLPSALNPKDKALKERSLRHQVRMMEVDSRLNVSWKIQSLVGVWWPCFLPRQALLF

SEQ ID NO: 14103 - protein, 463 aa, Artificial Sequence; identical to SEQ ID NO: 14101
  Description of Artificial Sequence: Synthetic coding sequence

SEQ ID NO: 14104 - protein, 148 aa, Artificial Sequence
  Description of Artificial Sequence: Synthetic coding sequence
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTGETSYLLPEPGSHPCWRAGSGQASCCGHMCRAPELPAGQVA

SEQ ID NO: 14105 - protein, 148 aa, Artificial Sequence; identical to SEQ ID NO: 14104
  Description of Artificial Sequence: Synthetic coding sequence

SEQ ID NO: 14106 - protein, 43 aa, Artificial Sequence
  Description of Artificial Sequence: Synthetic coding sequence
MAGAGERKGKKDDNGIGTAIDFVLSNARLVLGVGGAAMLGIAT

SEQ ID NO: 14107 - protein, 688 aa, Artificial Sequence
  Description of Artificial Sequence: Synthetic coding sequence
MAAEIDFLREQNRRLNEDFRRYQMESFSKYSSVQKAVCQGEGDDTFENLVFDQSFLAPLVTEYDKHLGELNGQLKYYQKQVGEMKLQLENVIKENERLHSELKDAVEKKLEAFPLGTEVGTDIYADDETVRNLQEQLQLANQEKTQAVELWQTVSQELDRLHKLYQEHMTEAQIHVFESQKQKDQLFDFQQLTKQLHVTNENMEVTNQQFLKTVTEQSVIIEQLRKKLRQAKLELRVAVAKVEELTNVTEDLQGQMKKKEKDVVSAHGREEASDRRLQQLQSSIKQLEIRLCVTIQEANQLRTENTHLEKQTRELQAKCNELENERYEAIVRARNSMQLLEEANLQKSQALLEEKQKEEDIEKMKETVSRFVQDATIRTKKEVANTKKQCNIQISRLTEELSALQMECAEKQGQIERVIKEKKAVEEELEKIYREGRGNESDYRKLEEMHQRFLVSERSKDDLQLRLTRAENRIKQLETDSSEEISRYQEMIQKLQNVLESERENCGLVSEQRLKLQQENKQLRKETESLRKIALEAQKKAKVKISTMEHEFSIKERGFEVQLREMEDSNRNSIVELRHLLATQQKAANRWKEETKKLTESAEIRINNLKSELSRQKLHTQELLSQLEMANEKVAENEKLILEHQEKANRLQRRLSQAEERAASASQQLSVITVQRRKAASLMNLENI

SEQ ID NO: 14108 - protein, 307 aa, Artificial Sequence
  Description of Artificial Sequence: Synthetic coding sequence
MAAEIDFLREQNRRLNEDFRRYQMESFSKYSSVQKAVCQGEGDDTFENLVFDQSFLAPLVTEYDKHLGELNGQLKYYQKQVGEMKLQLENVIKENERLHSELKDAVEKKLEAFPLGTEVGTDIYADDETVRNLQEQLQLANQEKTQAVELWQTVSQELDRLHKLYQEHMTEAQIHVFESQKQKDQLFDFQQLTKQLHVTNENMEVTNQQFLKTVTEQSVIIEQLRKKLRSELSRQKLHTQELLSQLEMANEKVAENEKLILEHQEKANRLQRRLSQAEERAASASQQLSVITVQRRKAASLMNLENI

SEQ ID NO: 14109 - protein, 175 aa, Artificial Sequence
  Description of Artificial Sequence: Synthetic coding sequence
MAAEIDFLREQNRRLNEDFRRYQMESFSKYSSVQKAVCQGEGDDTFENLVFDQSFLAPLVTEYDKHLGELNGQLKYYQKQVGEMKLQLENVIKENERSELSRQKLHTQELLSQLEMANEKVAENEKLILEHQEKANRLQRRLSQAEERAASASQQLSVITVQRRKAASLMNLENI

SEQ ID NO: 14110 - protein, 79 aa, Artificial Sequence
  Description of Artificial Sequence: Synthetic coding sequence
MAAEIDFLREQNRRLNEDFRRYQMESFSKYSSVQKAVCQGEGDDTFENLVFDQSFLAPLVTEYDKHLGELNGQLKYYQA

SEQ ID NO: 14111 - protein, 245 aa, Artificial Sequence
  Description of Artificial Sequence: Synthetic coding sequence
MEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLELLSLPPPDVWKLLYFQ

SEQ ID NO: 14112 - protein, 728 aa, Artificial Sequence
  Description of Artificial Sequence: Synthetic coding sequence
MGMARGSLTRVPGVMGEGTQGPELSLDPDPCSPQSTPGLMKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 14113 - protein, 692 aa, Artificial Sequence
  Description of Artificial Sequence: Synthetic coding sequence
MSSIKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 14114 - protein, 158 aa, Artificial Sequence
  Description of Artificial Sequence: Synthetic coding sequence
MVPHAILARGRDVCRRNGLLILSVLSVIVGCLLGFFLRTRRLSPQEISYFQFPGELLMRMLKMMILPLVVSSLMSGLASLDAKTSSRLGVLTVAYYLWTTFMAVIVGIFMVSIIHPGSAAQKETTEQSGKPIMSSADALLDLIRQKEESWRNGPKGPG

SEQ ID NO: 14115 - protein, 560 aa, Artificial Sequence
  Description of Artificial Sequence: Synthetic coding sequence
MVPHAILARGRDVCRRNGLLILSVLSVIVGCLLGFFLRTRRLSPQEISYFQFPGELLMRMLKMMILPLVVSSLMSGLASLDAKTSSRLGVLTVAYYLWTTFMAVIVGIFMVSIIHPGSAAQKETTEQSGKPIMSSADALLDLIRNMFPANLVEATFKQYRTKTTPVVKSPKVAPEEAPPRRILIYGVQEENGSHVQNFALDLTPPPEVVYKSEPGTSDGMNVLGIVFFSATMGIMLGRMGDSGAPLVSFCQCLNESVMKIVAVAVWYFPFGIVFLIAGKILEMDDPRAVGKKLGFYSVTVVCGLVLHGLFILPLLYFFITKKNPIVFIRGILQALLIALATSSSSATLPITFKCLLENNHIDRRIARFVLPVGATINMDGTALYEAVAAIFIAQVNNYELDFGQIITISITATAASIGAAGIPQAGLVTMVIVLTSVGLPTDDITLIIAVDWALDRFRTMINVLGDALAAGIMAHICRKDFARDTGTEKLLPCETKPVSLQEIVAAQQNGCVKSVAEASELTLGPTCPHHVPVQVEQDEELPAASLNHCTIQISELETNV

SEQ ID NO: 14116 - protein, 564 aa, Artificial Sequence
  Description of Artificial Sequence: Synthetic coding sequence
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITAMGTSSSSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 14117 - protein, 500 aa, Artificial Sequence
  Description of Artificial Sequence: Synthetic coding sequence
MSIDHEQPWQQPVPAGERPAAGPGGLAAAAAGKPAAESTAHAPAPADHDPRARAALPAPKRLHSADGQRRGHWGQPGLCPAPISAHLPPDQVLLFSWRASDEDAADAGVTSHCLQPGHRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITAMGTSSSSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 14118 - protein, 205 aa, Artificial Sequence
  Description of Artificial Sequence: Synthetic coding sequence
TMSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQVRGKYTV

SEQ ID NO: 14119 - protein, 312 aa, Artificial Sequence
  Description of Artificial Sequence: Synthetic coding sequence
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIW

SEQ ID NO: 14120 - protein, 438 aa, Artificial Sequence
  Description of Artificial Sequence: Synthetic coding sequence
MIRKLFIVLLLLLVTIEEARMSSLSFLNIEKTEILFFTKTEETILVSSSYENKRPNSSHLFVKIEDPKILQMVNVAKKISSDATNFTINLVTDEEGETNVTIQLWDSEGRQERLIEEIKNVKVKVLKQKDSLLQAPMHIDRNILMLILPLILLNKCAFGCKIELQLFQTVWKRPLPVILGAVTQFFLMPFCGFLLSQIVALPEAQAFGVVMTCTCPGGGGGYLFALLLDGDFTLAILMTCTSTLLALIMMPVNSYIYSRILGLSGTFHIPVSKIVSTLLFILVPVSIGIVIKHRIPEKASFLERIIRPLSFILMFVGIYLTFTVGLVFLKTDNLEVILLGLLVPALGLLFGYSFAKVCTLPLPVCKTVAIESGMLNSFLALAVIQLSFPQSKANLASVAPFTVAMCSGCEMLLIILVYKAKKRCIFFLQDKRKRNFLI

SEQ ID NO: 14121 - protein, 85 aa, Artificial Sequence
  Description of Artificial Sequence: Synthetic coding sequence
MRLLERMRKDWFMVGIVLAIAGAKLEPSIGVNGGPLKPEITVSYIAVATIFFNSGLSLKTEFADSRLHASACVFCSDFNQGSWWK

SEQ ID NO: 14122 - protein, 340 aa, Artificial Sequence
  Description of Artificial Sequence: Synthetic coding sequence
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEAAAIFNSAFGSFLGIVITPLLLLLFLGSSSSVPFTSIFSQLFMTVVVPLIIGQIVRRYIKDWLERKKPPFGAISSSVLLMIIYTTFCDTFSNPNIDLDKFSLVLILFIIFSIQLSFMLLTFIFSTRNNSGFTPADTVAIIFCSTHKSLTLGIPMLKIVFAGHEHLSLISVPLLIYHPAQILLGSVLVPTIKSWMVSRQKGVKLTRPTV

SEQ ID NO: 14123 - protein, 159 aa, Artificial Sequence
  Description of Artificial Sequence: Synthetic coding sequence
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEAAAIFNSAFGSFLVSKHSLTCLLQLLL

SEQ ID NO: 14124 - protein, 358 aa, Artificial Sequence
  Description of Artificial Sequence: Synthetic coding sequence
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEAAAIFNSAFGSFLGIVITPLLLLLFLGSSSSVPFTSIFSQLFMTVVVPLIIGQIVRRYIKDWLERKKPPFGAISSSVLLMIIYTTFCDTFSNPNIDLDKFSLVLILFIIFSIQLSFMLLTFIFSTRNNSGFTPADTVAIIFCSTHKSLTLGIPMLKIVFAGHEHLSLISVPLLIYHPAQILLGSVLVPTIKSWMVSRQKKLLQTRGPLANLNNPEGLEYLSIKFGH

SEQ ID NO: 14125 - protein, 327 aa, Artificial Sequence
  Description of Artificial Sequence: Synthetic coding sequence
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEGIVITPLLLLLFLGSSSSVPFTSIFSQLFMTVVVPLIIGQIVRRYIKDWLERKKPPFGAISSSVLLMIIYTTFCDTFSNPNIDLDKFSLVLILFIIFSIQLSFMLLTFIFSTRNNSGFTPADTVAIIFCSTHKSLTLGIPMLKIVFAGHEHLSLISVPLLIYHPAQILLGSVLVPTIKSWMVSRQKGVKLTRPTV

SEQ ID NO: 14126 - protein, 64 aa, Artificial Sequence
  Description of Artificial Sequence: Synthetic coding sequence
MRLLERMRKDWFMVGIVLAIAGAKLEPSIGVNGGPLKPEITVSYIAVATIFFNSGLSLKTELLT

SEQ ID NO: 14127 - protein, 358 aa, Artificial Sequence; identical to SEQ ID NO: 14124
  Description of Artificial Sequence: Synthetic coding sequence

SEQ ID NO: 14128 - protein, 568 aa, Artificial Sequence
  Description of Artificial Sequence: Synthetic coding sequence
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTCHLGLTAQPELYLLNTMDADSLVSR

SEQ ID NO: 14129 - protein, 561 aa, Artificial Sequence
  Description of Artificial Sequence: Synthetic coding sequence
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 14130 - protein, 590 aa, Artificial Sequence
  Description of Artificial Sequence: Synthetic coding sequence
MRKKQLKTEAAPHCELKSYSKNSATQVSTMVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 14131 - protein, 561 aa, Artificial Sequence; identical to SEQ ID NO: 14129
  Description of Artificial Sequence: Synthetic coding sequence

SEQ ID NO: 14132 - protein, 557 aa, Artificial Sequence
  Description of Artificial Sequence: Synthetic coding sequence
MSTVDYLNSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 14133 - protein, 568 aa, Artificial Sequence; identical to SEQ ID NO: 14128
  Description of Artificial Sequence: Synthetic coding sequence

SEQ ID NO: 14134 - protein, 482 aa, Artificial Sequence
  Description of Artificial Sequence: Synthetic coding sequence
MSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 14135 - protein, 568 aa, Artificial Sequence; identical to SEQ ID NO: 14128
  Description of Artificial Sequence: Synthetic coding sequence

SEQ ID NO: 14136 - protein, 590 aa, Artificial Sequence; identical to SEQ ID NO: 14130
  Description of Artificial Sequence: Synthetic coding sequence

SEQ ID NO: 14137 - protein, 3 aa, Artificial Sequence
  Description of Artificial Sequence: Synthetic coding sequence
MVL

SEQ ID NO: 14138 - protein, 149 aa, Artificial Sequence
  Description of Artificial Sequence: Synthetic coding sequence
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVIL

SEQ ID NO: 14139 - protein, 714 aa, Artificial Sequence
  Description of Artificial Sequence: Synthetic coding sequence
MTQMSQVQELFHEAAQQDALAQPQPWWKTQLFMWEPVLFGTWDGVFTSCMINIFGVVLFLRTGWLVGNTGVLLGMFLVSFVILVALVTVLSGIGVGERSSIGSGGVYSMISSVLGGQTGGTIGLLYVFGQCVAGAMYITGFAESISDLLGLGNIWAVRGISVAVLLALLGINLAGVKWIIRLQLLLLFLLAVSTLDFVVGSFTHLDPEHGFIGYSPELLQNNTLPDYSPGESFFTVFGVFFPAATGVMAGFNMGGDLREPAASIPPGSLAAVGISWFLYIIFVFLLGAICTREALRYDFLIAEKVSLMGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLREGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEDFFLKSRLQEQDVWRRSTSFYTHMCNPWVSLLGAVGSLLIMFVIQWVYTLVNMGVAAIVYFYIGRASPGLHLGSASNFSFFRWMRSLLLPSCRSLRSPQEQIILAPSLAKVDMEMTQLTQENADFATRDRYHHSSLVNREQLMPHY

SEQ ID NO: 14140 - protein, 714 aa, Artificial Sequence; identical to SEQ ID NO: 14139
  Description of Artificial Sequence: Synthetic coding sequence

SEQ ID NO: 14141 - protein, 538 aa, Artificial Sequence
  Description of Artificial Sequence: Synthetic coding sequence
MASESSPLLAYRLLGEEGVALPANGAGGPGGASARKLSTFLGVVVPTVLSMFSIVVFLRIDATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLESNSHPLP

SEQ ID NO: 14142 - protein, 914 aa, Artificial Sequence
  Description of Artificial Sequence: Synthetic coding sequence
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 14143 - protein, 538 aa, Artificial Sequence; identical to SEQ ID NO: 14141
  Description of Artificial Sequence: Synthetic coding sequence

SEQ ID NO: 14144 - protein, 627 aa, Artificial Sequence
  Description of Artificial Sequence: Synthetic coding sequence
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLESNSHPLP

SEQ ID NO: 14145 - protein, 129 aa, Artificial Sequence
  Description of Artificial Sequence: Synthetic coding sequence
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANV

SEQ ID NO: 14146 - protein, 486 aa, Artificial Sequence
  Description of Artificial Sequence: Synthetic coding sequence
HFGVHWHSLVFTGILGVHWHFGTTARLLALAQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRHRRRAGWAGGWGC

SEQ ID NO: 14147 - protein, 631 aa, Artificial Sequence
  Description of Artificial Sequence: Synthetic coding sequence
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLESGTLLPWGFRS

SEQ ID NO: 14148 - protein, 698 aa, Artificial Sequence
  Description of Artificial Sequence: Synthetic coding sequence
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 14149 - protein, 729 aa, Artificial Sequence
  Description of Artificial Sequence: Synthetic coding sequence
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 14150 - protein, 691 aa, Artificial Sequence
  Description of Artificial Sequence: Synthetic coding sequence
MSPRKLFFPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 14151 - protein, 581 aa, Artificial Sequence
  Description of Artificial Sequence: Synthetic coding sequence
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 14152 - protein, 313 aa, Artificial Sequence
  Description of Artificial Sequence: Synthetic coding sequence
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFTGASTWVLCCRCWWWRLFSRTSASCWATASLWAVWAWHFSSSSLPPPSSSPSPRWAAKCPLCLSSLSKTAAPSCGNDTRPETVNVPACWPTRGLPSQGLPRKRTSPTSRCW

SEQ ID NO: 14153 - protein, 577 aa, Artificial Sequence
  Description of Artificial Sequence: Synthetic coding sequence
MEGSGGGAGERAPLLGARRAAAAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 14154 - protein, 439 aa, Artificial Sequence
  Description of Artificial Sequence: Synthetic coding sequence
MLKREGKVQPYTKTLDGGWGWMIVIHFFLVNVFVMGMTKTFAIFFVVFQEEFEGTSEQIGWIGSIMSSLRFCAGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 14155 - protein, 471 aa, Artificial Sequence
  Description of Artificial Sequence: Synthetic coding sequence
MPAPQRKHRRGGFSHRCFPTPQTAMTPQPAGPPDGGWGWVVAAAAFAINGLSYGLLRSLGLAFPDLAEHFDRSAQDTAWISALALAVQQAASPVGSALSTRWGARPVVMVGGVLASLGFVFSAFASDLLHLYLGLGLLAGFGWALVFAPALGTLSRYFSRRRVLAVGLALTGNGASSLLLAPALQLLLDTFGWRGALLLLGAITLHLTPCGALLLPLVLPGDPPAPPRSPLAALGLSLFTRRAFSIFALGTALVGGGYFVPYVHLAPHALDRGLGGYGAALVVAVAAMGDAGARLVCGWLADQGWVPLPRLLAVFGALTGLGLWVVGLVPVVGGEESWGGPLLAAAVAYGLSAGSYAPLVFGVLPGLVGVGGVVQATGLVMMLMSLGGLLGPPLSGFLRDETGDFTASFLLSGSLILSGSFIYIGLPRALPSCGPASPPATPPPETGELLPAPQAVLLSPGGPGSTLDTTC

SEQ ID NO: 14156 - protein, 439 aa, Artificial Sequence
  Description of Artificial Sequence: Synthetic coding sequence
MTPQPAGPPDGGWGWVVAAAAFAINGLSYGLLRSLGLAFPDLAEHFDRSAQDTAWISALALAVQQAASPVGSALSTRWGARPVVMVGGVLASLGFVFSAFASDLLHLYLGLGLLAGFGWALVFAPALGTLSRYFSRRRVLAVGLALTGNGASSLLLAPALQLLLDTFGWRGALLLLGAITLHLTPCGALLLPLVLPGDPPAPPRSPLAALGLSLFTRRAFSIFALGTALVGGGYFVPYVHLAPHALDRGLGGYGAALVVAVAAMGDAGARLVCGWLADQGWVPLPRLLAVFGALTGLGLWVVGLSWGGPLLAAAVAYGLSAGSYAPLVFGVLPGLVGVGGVVQATGLVMMLMSLGGLLGPPLSGFLRDETGDFTASFLLSGSLILSGSFIYIGLPRALPSCGPASPPATPPPETGELLPAPQAVLLSPGGPGSTLDTTC

SEQ ID NO: 14157 - protein, 426 aa, Artificial Sequence
  Description of Artificial Sequence: Synthetic coding sequence
MARRTEPPDGGWGWVVVLSAFFQSALVFGVLRSFGVFFVEFVAAFEEQAARVSWIASIGIAVQQFGSPVGSALSTKFGPRPVVMTGGILAALGMLLASFATSLTHLYLSIGLLSGSGWALTFAPTLACLSCYFSRRRSLATGLALTGVGLSSFTFAPFFQWLLSHYAWRGSLLLVSALSLHLVACGALLRPPSLAEDPAVGGPRAQLTSLLHHGPFLRYTVALTLINTGYFIPYLHLVAHLQDLDWDPLPAAFLLSVVAISDLVGRVVSGWLGDAVPGPVTRLLMLWTTLTGVSLALFPVAQAPTALVALAVAYGFTSGALAPLAFSVLPELIGTRRIYCGLGLLQMIESIGGLLGPPLSGYLRDVTGNYTASFVVAGAFLLSGSGILLTLPHFFCFSTTTSGPQDLVTEALDTKVPLPKEGLEED

SEQ ID NO: 14158 - protein, 510 aa, Artificial Sequence
  Description of Artificial Sequence: Synthetic coding sequence
MYTSHEDIGYDFEDGPKDKKTLKPHPNIDGGWAWMMVLSSFFVHILIMGSQMALGVLNVEWLEEFHQSRGLTAWVSSLSMGITLIVGPFIGLFINTCGCRQTAIIGGLVNSLGWVLSAYAANVHYLFITFGVAAGLGSGMAYLPAVVMVGRYFQKRRALAQGLSTTGTGFGTFLMTVLLKYLCAEYGWRNAMLIQGAVSLNLCVCGALMRPLSPGKNPNDPGEKDVRGLPAHSTESVKSTGQQGRTEEKDGGLGNEETLCDLQAQECPDQAGHRKNMCALRILKTVSWLTMRVRKGFEDWYSGYFGTASLFTNRMFVAFIFWALFAYSSFVIPFIHLPEIVNLYNLSEQNDVFPLTSIIAIVHIFGKVILGVIADLPCISVWNVFLLANFTLVLSIFILPLMHTYAGLAVICALIGFSSGYFSLMPVVTEDLVGIEHLANAYGIIICANGISALLGPPFAGWIYDITQKYDFSFYICGLLYMIGILFLLIQPCIRIIEQSRRKYMDGAHV

SEQ ID NO: 14159 - protein, 485 aa, Artificial Sequence
  Description of Artificial Sequence: Synthetic coding sequence
MYTSHEDIGYDFEDGPKDKKTLKPHPNIDGGWAWMMVLSSFFVHILIMGSQMALGVLNVEWLEEFHQSRGLTAWVSSLSMGITLIVGPFIGLFINTCGCRQTAIIGGLVNSLGWVLSAYAANVHYLFITFGVAAGLGSGMAYLPAVVMVGRYFQKRRALAQGLSTTGTGFGTFLMTVLLKYLCAEYGWRNAMLIQGAVSLNLCVCGALMRPLSPGKNPNDPGEKDVRGLPAHSTESVKSTGQQGRTEEKDGGLGNEETLCDLQAQECPDQAGHRKNMCALRILKTVSWLTMRVRKGFEDWYSGYFGTASLFTNRMFVAFIFWALFAYSSFVIPFIHLPEIVNLYNLSEQNDVFPLTSIIAIVHIFGKVILGVIADLPCISVWNVFLLANFTLVLSIFILPLMHTYAGLAVICALIGFSSGYFSLMPVVTEDLVGIEHLANAYGIIICANGISALLGPPFAGKLSEVLRAQSACTYGALCYKVPDK

SEQ ID NO: 14160 - protein, 42 aa, Artificial Sequence
  Description of Artificial Sequence: Synthetic coding sequence
MYTSHEDIGYDFEDGPKDKKTLKPHPNIDGGWAWMMVLSSFF

SEQ ID NO: 14161 - protein, 18 aa, Artificial Sequence
  Description of Artificial Sequence: Synthetic coding sequence
MYTSHEDIGYDFEDGPKD

SEQ ID NO: 14162 - protein, 489 aa, Artificial Sequence
  Description of Artificial Sequence: Synthetic coding sequence
MYTSHEDIGYDFEDGPKDKKTLKPHPNIDGGWAWMMVLSSFFVHILIMGSQMALGVLNVEWLEEFHQSRGLTAWVSSLSMGITLIVGPFIGLFINTCGCRQTAIIGGLVNSLGWVLSAYAANVHYLFITFGVAAGLGSGMAYLPAVVMVGRYFQKRRALAQGLSTTGTGFGTFLMTVLLKYLCAEYGWRNAMLIQGAVSLNLCVCGALMRPLSPGKNPNDPGEKDVRGLPAHSTESVKSTGQQGRTEEKDGGLGNEETLCDLQAQECPDQAGHRKNMCALRILKTVSWLTMRVRKGFEDWYSGYFGTASLFTNRMFVAFIFWALFAYSSFVIPFIHLPEIVNLYNLSEQNDVFPLTSIIAIVHIFGKVILGVIADLPCISVWNVFLLANFTLVLSIFILPLMHTYAGLAVICALIGFSSGYFSLMPVVTEDLVGIEHLANAYGIIICANGISALLGPPFAGKLSEVLRAQSACTYGALCYKVPDKEEGF

SEQ ID NO: 14163 - protein, 487 aa, Artificial Sequence
  Description of Artificial Sequence: Synthetic coding sequence
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 14164 - protein, 319 aa, Artificial Sequence
  Description of Artificial Sequence: Synthetic coding sequence
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 14165 - protein, 382 aa, Artificial Sequence
  Description of Artificial Sequence: Synthetic coding sequence
MGMDDCDSFFPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAEIIPSFQAGYMIIPRHTMALSTSLAYAISSLQFPFFLYHWPKDGKTV

SEQ ID NO: 14166 - protein, 425 aa, Artificial Sequence
  Description of Artificial Sequence: Synthetic coding sequence
MGMDDCDSFFPGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 14167 - protein, 505 aa, Artificial Sequence
  Description of Artificial Sequence: Synthetic coding sequence
MPQALERADGSWAWVVLLATMVTQGLTLGFPTCIGIFFTELQWEFQASNSETSWFPSILTAVLHMAGPLCSILVGRFGCRVTVMLGGVLASLGMVASSFSHNLSQLYFTAGFITGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNTGYCVYILGVMWSVLGFPLPQVFLVPYAMWHSVDEQQAALLISIIGFSNIFLRPLAGLMAGRPAFASHRKYLFSLALLLNGLTNLVCAASGDFWVLVGYCLAYSVSMSGIGALIFQVLMDIVPMDQFPRALGLFTVLDGLAFLISPPLAGLLLDATNNFSYVFYMSSFFLISAALFMGGSFYALQKKEQGKQAVAADALERDLFLEAKDGPGKQRSPEIMCQSSRQPRPAGVNKHLWGCPASSRTSHEWLLWPKAVLQAKQTALGWNSPT

SEQ ID NO: 14168 - protein, 505 aa, Artificial Sequence; identical to SEQ ID NO: 14167
  Description of Artificial Sequence: Synthetic coding sequence

SEQ ID NO: 14169 - protein, 500 aa, Artificial Sequence
  Description of Artificial Sequence: Synthetic coding sequence
MPRPTRGPLATSQGWCPSVTPGTWAAATLAVRPWQRRQQRMPQALERADGSWAWVVLLATMVTQGLTLGFPTCIGIFFTELQWEFQASNSETSWFPSILTAVLHMAGPLCSILVGRFGCRVTVMLGGVLASLGMVASSFSHNLSQLYFTAGFITGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNTGYCVYILGVMWSVLGFPLPQVFLVPYAMWHSVDEQQAALLISIIGFSNIFLRPLAGLMAGRPAFASHRKYLFSLALLLNGLTNLVCAASGDFWVLVGYCLAYSVSMSGIGALIFQVLMDIVPMDQFPRALGLFTVLDGLAFLISPPLAGLLLDATNNFSYVFYMSSFFLISAALFMGGSFYALQKKEQGKQAVAADALERDLFLEAKDGPGKQRSPEIMYVTSV

SEQ ID NO: 14170 - protein, 523 aa, Artificial Sequence
  Description of Artificial Sequence: Synthetic coding sequence
MTQNKLKLCSKANVYTEVPDGGWGWAVAVSFFFVEVFTYGIIKTFGVFFNDLMDSFNESNSRISWIISICVFVLTFSAPLATVLSNRFGHRLVVMLGGLLVSTGMVAASFSQEVSHMYVAIGIISGLGYCFSFLPTVTILSQYFGKRRSIVTAVASTGECFAVFAFAPAIMALKERIGWRYSLLFVGLLQLNIVIFGALLRPIFIRGPASPKIVIQENRKEAQYMLENEKTRTSIDSIDSGVELTTSPKNVPTHTNLELEPKADMQQVLVKTSPRPSEKKAPLLDFSILKEKSFICYALFGLFATLGFFAPSLYIIPLGISLGIDQDRAAFLLSTMAIAEVFGRIGAGFVLNREPIRKIYIELICVILLTVSLFAFTFATEFWGLMSCSIFFGFMVGTIGGTHIPLLAEDDVVGIEKMSSAAGVYIFIQSIAGLAGPPLAGLLVDQSKIYSRAFYSCAAGMALAAVCLALVRPCKMGLCQHHHSGETKVVSHRGKTLQDIPEDFLEMDLAKNEHRVHVQMEPV

SEQ ID NO: 14171 - protein, 504 aa, Artificial Sequence
  Description of Artificial Sequence: Synthetic coding sequence
MGAGGPRRGEGPPDGGWGWVVLGACFVVTGFAYGFPKAVSVFFRALMRDFDAGYSDTAWVSSIMLAMLYGTGPVSSILVTRFGCRPVMLAGGLLASAGMILASFATRLLELYLTAGVLTGLGLALNFQPSLIMLGLYFERRRPLANGLAAAGSPVFLSALSPLGQQLLERFGWRGGFLLLGGLLLHCCACGAVMRPPPGPGPRPRRDSAGDRAGDAPGEAEADGAGLQLREASPRVRPRRRLLDLAVCTDRAFAVYAVTKFLMALGLFVPAILLVNYAKDAGVPDTDAAFLLSIVGFVDIVARPACGALAGLARLRPHVPYLFSLALLANGLTDLSSARARSYGALVAFCVAFGLSYGMVGALQFEVLMAAVGAPRFPSALGLVLLVEAAAVLIGPPSAGRLVDVLKNYEIIFYLAGSEVALAGVFMAVATNCCLRCAKAAPSGPGTEGGASDTEDAEAEGDSEPLPVVAEEPGNLEALEVLSARGEPTEPEIEARPRLAAESV

SEQ ID NO: 14172 - protein, 97 aa, Artificial Sequence
  Description of Artificial Sequence: Synthetic coding sequence
MGAGGPRRGEGPPDGGWGWVVLGACFVVTGFAYGFPKAVSVFFRALMRDFDAGYSDTAWVSSIMLAMLYGTGPVSSILVTRFGCRPVMLAGGLLASA

SEQ ID NO: 14173 - protein, 499 aa, Artificial Sequence
  Description of Artificial Sequence: Synthetic coding sequence
MLHALLRSRMIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 14174 - protein, 496 aa, Artificial Sequence
  Description of Artificial Sequence: Synthetic coding sequence
MRALRRLIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 14175 - protein, 503 aa, Artificial Sequence
  Description of Artificial Sequence: Synthetic coding sequence
MEDELEPSLRPRTQIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 14176 - protein, 367 aa, Artificial Sequence
  Description of Artificial Sequence: Synthetic coding sequence
MEDELEPSLRPRTQIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSVSLEGALPPPALWGGTPRSSALNQFTLQKKKK

SEQ ID NO: 14177 - protein, 367 aa, Artificial Sequence
  Description of Artificial Sequence: Synthetic coding sequence
MRALRRLIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLSTTAAPGLRGLGRGAGGAGGGARCLPGLPCRPWELFQHRALRRQVTSLVVLGSAMELCGNDSVYAYASSVFRKAGVPEAKIQYAIIGTGSCELLTAVVSVSLEGALPPPALWGGTPRSSALNQFTLQLMVLKCSEGPGAVAHACKPSTLGGRGGWITRSGVRDQPGQHSETPVSTKKYKKLSRRGGGRL

SEQ ID NO: 14178 - protein, 463 aa, Artificial Sequence
  Description of Artificial Sequence: Synthetic coding sequence
MEDELEPSLRPRTQIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSVAGVDEGWGVQAGLTSTSPPPRPRQSSFPWTLYLAMACIFAFILSFGIGPAGVTGILATELFDQMARPAACMVCGALMWIMLILVGLGFPFIMVLGSFLIAGGLVPLPLCPFPWCLCLWGHLHWPVPS

SEQ ID NO: 14179 - protein, 617 aa, Artificial Sequence
  Description of Artificial Sequence: Synthetic coding sequence
MVPVENTEGPSLLNQKGTAVETEGSGSRHPPWARGCGMFTFLSSVTAAVSGLLVGYELGIISGALLQIKTLLALSCHEQEMVVSSLVIGALLASLTGGVLIDRYGRRTAIILSSCLLGLGSLVLILSLSYTVLIVGRIAIGVSISLSSIATCVYIAEIAPQHRRGLLVSLNELMIVIGILSAYISNYAFANVFHGWKYMFGLVIPLGVLQAIAMYFLPPSPRFLVMKGQEGAASKVLGRLRALSDTTEELTVIKSSLKDEYQYSFWDLFRSKDNMRTRIMIGLTLVFFVQITGQPNILFYASTVLKSVGFQSNEAASLASTGVGVVKVISTIPATLLVDHVGSKTFLCIGSSVMAASLVTMGIVNLNIHMNFTHICRSHNSINQSLDESVIYGPGNLSTNNNTLRDHFKGISSHSRSSLMPLRNDVDKRGETTSASLLNAGLSHTEYQIVTDPGDVPAFLKWLSLASLLVYVAAFSIGLGPMPWLVLSEIFPGGIRGRAMALTSSMNWGINLLISLTFLTVTDLIGLPWVCFIYTIMSLASLLFVVMFIPETKGCSLEQISMELAKVNYVKNNICFMSHHQEELVPKQPQKRKPQEQLLECNKLCGRGQSRQLSPET

SEQ ID NO: 14180 - protein, 551 aa, Artificial Sequence
  Description of Artificial Sequence: Synthetic coding sequence
MAQFVQVLAEIGDFGRFQIQLLILLCVLNFLSPFYFFAHVFMVLDEPHHCAVAWVKNHTFNLSAAEQLVLSVPLDTAGHPEPCLMFRPPPANASLQDILSHRFNETQPCDMGWEYPENRLPSLKNEFNLVCDRKHLKDTTQSVFMAGLLVGTLMFGPLCDRIGRKATILAQLLLFTLIGLATAFVPSFELYMALRFAVATAVAGLSFSNVTLLTEWVGPSWRTQAVVLAQCNFSLGQMVLAGLAYGFRNWRLLQITGTAPGLLLFFYFWALPESARWLLTRGRMDEAIQLIQKAASVNRRKLSPELMNQLVPEKTGPSGNALDLFRHPQLRKVTLIIFCVWFVDSLGYYGLSLQVGDFGLDVYLTQLIFGAVEVPARCSSIFMMQRFGRKWSQLGTLVLGGLMCIIIIFIPADLPVVVTMLAVVGKMATAAAFTISYVYSAELFPTILRQTGMGLVGIFSRIGGILTPLVILLGEYHAALPMLIYGSLPIVAGLLCTLLPETHGQGLKDTLQDLELGPHPRSPKSVPSEKETEAKGRTSSPGVAFVSSTYF

SEQ ID NO: 14181 - protein, 205 aa, Artificial Sequence
  Description of Artificial Sequence: Synthetic coding sequence
MVLDEPHHCAVAWVKNHTFNLSAAEQLVLSVPLDTAGHPEPCLMFRPPPANASLQDILSHRFNETQPCDMGWEYPENRLPSLKNEFNLVCDRKHLKDTTQSVFMAGLLVGTLMFGPLCDRDRMGGALMEDAGRGPGPVQLLPRADGACGTRLRFPQLEAPSDHRHCAWLTALLLLLGSARICTLAPDPWEDGRGDTTDPEGGLGQ

SEQ ID NO: 14182 - protein, 553 aa, Artificial Sequence
  Description of Artificial Sequence: Synthetic coding sequence
MAFQDLLGHAGDLWRFQILQTVFLSIFAVATYLHFMLENFTAFIPGHRCWVHILDNDTVSDNDTGALSQDALLRISIPLDSNMRPEKCRRFVHPQWQLLHLNGTFPNTSDADMEPCVDGWVYDRISFSSTIVTEWDLVCDSQSLTSVAKFVFMAGMMVGGILGGHLSDRFGRRFVLRWCYLQVAIVGTCAALAPTFLIYCSLRFLSGIAAMSLITNTIMLIAEWATHRFQAMGITLGMCPSGIAFMTLAGLAFAIRDWHILQLVVSVPYFVIFLTSSWLLESARWLIINNKPEEGLKELRKAAHRSGMKNARDTLTLEILKSTMKKELEAAQKKKPSLCEMLHMPNICKRISLLSFTRFANFMAYFGLNLHVQHLGNNVFLLQTLFGAVILLANCVAPWALKYMNRRASQMLLMFLLAICLLAIIFVPQEMQTLREVLATLGLGASALANTLAFAHGNEVIPTIIRARAMGINATFANIAGALAPLMMILSVYSPPLPWIIYGVFPFISGFAFLLLPETRNKPLFDTIQDEKNERKDPREPKQEDPRVEVTQF

SEQ ID NO: 14183 - protein, 238 aa, Artificial Sequence
  Description of Artificial Sequence: Synthetic coding sequence
MAFQDLLGHAGDLWRFQILQTVFLSIFAVATYLHFMLENFTAFIPGHRCWVHILDNDTVSDNDTGALSQDALLRISIPLDSNMRPEKCRRFVHPQWQLLHLNGTFPNTSDADMEPCVDGWVYDRISFSSTIVTEWDLVCDSQSLTSVAKFVFMAGMMVGGILGGHLSDSSRVGNTQIPGHGNYIGNVPFWYCIYDPGRPGFCHSRLAYPPAGGVCTILCDLSDLKLAARVCSVAHYQQ

SEQ ID NO: 14184 - protein, 541 aa, Artificial Sequence
  Description of Artificial Sequence: Synthetic coding sequence
MAFEELLSQVGGLGRFQMLHLVFILPSLMLLIPHILLENFAAAIPGHRCWVHMLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRFANTIPFYGTMVNLQHVGSNIFLLQVLYGAVALIVRCLALLTLNHMGRRISQILFMFLVGLSILANTFVPKEMQTLRVALACLGIGCSAATFSSVAVHFIELIPTVLRARASGIDLTASRIGAALAPLLMTLTVFFTTLPWIIYGIFPIIGGLIVFLLPETKNLPLPDTIKDVENQKKNLKEKA

SEQ ID NO: 14185 - protein, 372 aa, Artificial Sequence
  Description of Artificial Sequence: Synthetic coding sequence
MLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRFANTIPFYGTMVNLQHVGSNIFLLQKCRPCVWLWHVWESAVLLLLFPVLLFTSLNSSPLFSGQELQE

SEQ ID NO: 14186 - protein, 147 aa, Artificial Sequence
  Description of Artificial Sequence: Synthetic coding sequence
MIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLR

SEQ ID NO: 14187 - protein, 269 aa, Artificial Sequence
  Description of Artificial Sequence: Synthetic coding sequence
MLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRFANTIPFYGTMVNLQHVGSNIFLLQKCRPCVWLWHVWESAVLLLLFPVLLFTSLNSSPLFSGQELQE

SEQ ID NO: 14188 - protein, 594 aa, Artificial Sequence
  Description of Artificial Sequence: Synthetic coding sequence
MAGEENFKEELRSQDASRNLNQHEVAGHPHSWSLEMLLRRLRAVHTKQDDKFANLLDAVGEFGTFQQRLVALTFIPSIMSAFFMFADHFVFTAQKPYCNTSWILAVGPHLSKAEQLNLTIPQAPNGSFLTCFMYLPVPWNLDSIIQFGLNDTDTCQDGWIYPDAKKRSLINEFDLVCGMETKKDTAQIMFMAGLPIGSLIFRLITDKMGRYPAILLSLLGLIIFGFGTAFMNSFHLYLFFRFGISQSVVGYAISSISLATEWLVGEHRAHAIILGHCFFAVGAVLLTGIAYSLPHWQLLFLVGGILVIPFISYIWILPESPRWLMMKGKVKEAKQVLCYAASVNKKTIPSNLLDELQLPRKKVTRASVLDFCKNRQLCKVTLVMSCVWFTVSYTYFTLSLRMRELGVSVHFRHVVPSIMEVPARLCCIFLLQQIGRKWSLAVTLLQAIIWCLLLLFLPEGEDGLRLKWPRCPATELKSMTILVLMLREFSLAATVTVFFLYTAELLPTVLRATGLGLVSLASVAGAILSLTIISQTPSLLPIFLCCVLAIVAFSLSSLLPETRDQPLSESLNHSSQIRNKVKDMKTKETSSDDV

SEQ ID NO: 14189 - protein, 594 aa, Artificial Sequence; identical to SEQ ID NO: 14188
  Description of Artificial Sequence: Synthetic coding sequence

SEQ ID NO: 14190 - protein, 424 aa, Artificial Sequence
  Description of Artificial Sequence: Synthetic coding sequence
MQGARAPRDQGRSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYGIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 14191 - protein, 424 aa, Artificial Sequence; identical to SEQ ID NO: 14190
  Description of Artificial Sequence: Synthetic coding sequence

SEQ ID NO: 14192 - protein, 424 aa, Artificial Sequence; identical to SEQ ID NO: 14190
  Description of Artificial Sequence: Synthetic coding sequence

SEQ ID NO: 14193 - protein, 326 aa, Artificial Sequence
  Description of Artificial Sequence: Synthetic coding sequence
MQGARAPRDQGRSPGRMSALGRSSVILLTYVLAATELTCLFMQFSIVPYLSRKLGLDSIAFGYLQTTFGVLQLLGGPVFGRIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 14194 - protein, 134 aa, Artificial Sequence
  Description of Artificial Sequence: Synthetic coding sequence
MQGARAPRDQGRSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLP

SEQ ID NO: 14195 - protein, 547 aa, Artificial Sequence
  Description of Artificial Sequence: Synthetic coding sequence
MAFQDLLDQVGGLGRFQILQMVFLIMFNVIVYHQTQLENFAAFILDHRCWVHILDNDTIPDNDPGTLSQDALLRISIPFDSNLRPEKCRRFVHPQWKLIHLNGTFPNTSEPDTEPCVDGWVYDQSSFPSTIVTKWDLVCESQPLNSVAKFLFMAGMMVGGNLYGHLSDRFGRKFVLRWSYLQLAIVGTCAAFAPTILVYCSLRFLAGAATFSIIVNTVLLIVEWITHQFCAMALTLTLCAASIGHITLGSLAFVIRDQCILQLVMSAPCFVFFLFSRWLAESARWLIINNKPEEGLKELRKAAHRNGMKNAEDILTMEVLKSTMKQELEAAQKKHSLCELLRIPNICKRICFLSFVRFASTIPFWGLTLHLQHLGNNVFLLQTLFGAVTLLANCVAPWALNHMSRRLSQMLLMFLLATCLLAIIFVPQEMQTLRVVLATLGVGAASLGITCSTAQENELIPSIIRGRATGITGNFANIGGALASLMMILSIYSRPLPWIIYGVFAILSGLVVLLLPETRNQPLLDSIQDVENEGVNSLAAPQRSSVL

SEQ ID NO: 14196 - protein, 234 aa, Artificial Sequence
  Description of Artificial Sequence: Synthetic coding sequence
MNMFGRKFVLRWSYLQLAIVGTCAAFAPTILVYCSLRFLAGAATFSIIVNTVLLIVEWITHQFCAMALTLTLCAASIGHITLGSLAFVIRDQCILQLVMSAPCFVFFLFSRWLAESARWLIINNKPEEGLKELRKAAHRNGMKNAEDILTMEVLKSTMKQELEAAQKKHSLCELLRIPNICKRICFLSFVRSAGVCWRSTPDPVCLGITSGGCRTAKIPACSFLWKLHFRGAPA

SEQ ID NO: 14197 - protein, 202 aa, Artificial Sequence
  Description of Artificial Sequence: Synthetic coding sequence
MAFQDLLDQVGGLGRFQILQMVFLIMFNVIVYHQTQLENFAAFILDHRCWVHILDNDTIPDNDPGTLSQDALLRISIPFDSNLRPEKCRRFVHPQWKLIHLNGTFPNTSEPDTEPCVDGWVYDQSSFPSTIVTKWDLVCESQPLNSVAKFLFMAGMMVGGNLYGHLSDRKPLSSPNHVSTDCDEGLEVPIAIHQHHVFWYLS

SEQ ID NO: 14198 - protein, 399 aa, Artificial Sequence
  Description of Artificial Sequence: Synthetic coding sequence
  MOD_RES (1)..(1): Any amino acid
XFQDLLDQVGGLGRFQILQMVFLIMFNVIVYHQTQLENFAAFILDHRCWVHILDNDTIPDNDPGTLSQDALLRISIPFDSNLRPEKCRRFVHPQWKLIHLNGTFPNTSEPDTEPCVDGWVYDQSSFPSTIVTKWDLVCESQPLNSVAKFLFMAGMMVGGNLYGHLSDRFGRKFVLRWSYLQLAIVGTCAAFAPTILVYCSLRFLAGAATFSIIVNTVLLIVEWITHQFCAMALTLTLCAASIGHITLGSLAFVIRDQCILQLVMSAPCFVFFLFSRWLAESARWLIINNKPEEGLKELRKAAHRNGMKNAEDILTMEVLKSTMKQELEAAQKKHSLCELLRIPNICKRICFLSFVRSAGVCWRSTPDPVCLGITSGGCRTAKIPACSFLWKLHFRGAPA

SEQ ID NO: 14199 - protein, 493 aa, Artificial Sequence
  Description of Artificial Sequence: Synthetic coding sequence
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNSSLMLHLCRGPSCHGLGHWNTSLQEVSGAVVVSGLLQGMMGLLGSPGHVFPHCGPLVLAPSLVVAGLSAHREVAQFCFTHWGLALLTWAPASFMCAPGGELQRHQLTLLSLSSGSFRNCLPPPRHHGFGCLTQAGSQQVAHLVGLLCVGLGLSPRLAQLLTTIPLPVVGGVLGVTQAVVLSAGFSSFYLADIDSGRNIFIVGFSIFMALLLPRWFREAPVLFSTGWSPLDVLLHSLLTQPIFLAGLSGFLLENTIPGTQLERGLGQGLPSPFTAQEARMPQKPREKAAQVYRLPFPIQNLCPCIPQPLHCLCPLPEDPGDEEGGSSEPEEMADLLPGSGEPCPESSREGFRSQK

SEQ ID NO: 14200 - protein, 194 aa, Artificial Sequence
  Description of Artificial Sequence: Synthetic coding sequence
MASLLCVSHLLLLCSLSPGGLSYSPSQLLASSFFSCGMSTILQTWMGSRLPLVQAPSLEFLIPALVLTSQKLPRAIQTPGNSSLMLHLCRGPSCHGLGHWNTSLQEGYPAHGGLFSAPGLLPVSCVPLEASFNVINSHSSPCLPAPFGADPSGLCVDCFCLCGIQCYPPGTVCPHQGTMDLAASPRLDLSKWLT

SEQ ID NO: 14201 - protein, 610 aa, Artificial Sequence
  Description of Artificial Sequence: Synthetic coding sequence
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNSSLMLHLCRGPSCHGLGHWNTSLQEVSGAVVVSGLLQGMMGLLGSPGHVFPHCGPLVLAPSLVVAGLSAHREVAQFCFTHWGLALLVILLMVVCSQHLGSCQFHVCPWRRASTSSTHTPLPVFRLLSVLIPVACVWIVSAFVGFSVIPQELSAPTKAPWIWLPHPGEWNWPLLTPRALAAGISMALAASTSSLGCYALCGRLLHLPPPPPHACSRGLSLEGLGSVLAGLLGSPMGTASSFPNVGKVGLIQAGSQQVAHLVGLLCVGLGLSPRLAQLLTTIPLPVVGGVLGVTQAVVLSAGFSSFYLADIDSGRNIFIVGFSIFMALLLPRWFREAPVLFSTGWSPLDVLLHSLLTQPIFLAGLSGFLLENTIPGTQLERGLGQGLPSPFTAQEARMPQKPREKAAQVYRLPFPIQNLCPCIPQPLHCLCPLPEDPGDEEGGSSEPEEMADLLPGSGEPCPESSREGFRSQK

SEQ ID NO: 14202 - protein, 618 aa, Artificial Sequence
  Description of Artificial Sequence: Synthetic coding sequence
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNCEHRARARASLMLHLCRGPSCHGLGHWNTSLQEVSGAVVVSGLLQGMMGLLGSPGHVFPHCGPLVLAPSLVVAGLSAHREVAQFCFTHWGLALLVILLMVVCSQHLGSCQFHVCPWRRASTSSTHTPLPVFRLLSVLIPVACVWIVSAFVGFSVIPQELSAPTKAPWIWLPHPGEWNWPLLTPRALAAGISMALAASTSSLGCYALCGRLLHLPPPPPHACSRGLSLEGLGSVLAGLLGSPMGTASSFPNVGKVGLIQAGSQQVAHLVGLLCVGLGLSPRLAQLLTTIPLPVVGGVLGVTQAVVLSAGFSSFYLADIDSGRNIFIVGFSIFMALLLPRWFREAPVLFSTGWSPLDVLLHSLLTQPIFLAGLSGFLLENTIPGTQLERGLGQGLPSPFTAQEARMPQKPREKAAQVYRLPFPIQNLCPCIPQPLHCLCPLPEDPGDEEGGSSEPEEMADLLPGSGEPCPESSREGFRSQK

SEQ ID NO: 14203 - protein, 477 aa, Artificial Sequence
  Description of Artificial Sequence: Synthetic coding sequence
MLRWLRDFVLPTAACQDAEQPTRYETLFQALDRNGDGVVDIGELQEGLRNLGIPLGQDAEEKIFTTGDVNKDGKLDFEEFMKYLKDHEKKMKLAFKSLDKNNDGKIEASEIVQSLQTLGLTISEQQAELILQSIDVDGTMTVDWNEWRDYFLFNPVTDIEEIIRFWKHSTGIDIGDSLTIPDEFTEDEKKSGQWWRQLLAGGIAGAVSRTSTAPLDRLKIMMQVHGSKSDKMNIFGGFRQMVKEGGIRSLWRGNGTNVIKIAPETAVKFWAYEQYKKLLTEEGQKIGTFERFISGSMAGATAQTFIYPMEVMKTRLAVGKTGQYSGIYDCAKKILKHEGLGAFYKGYVPNLLGIIPYAGIDLAVYELLKSYWLDNFAKDSVNPGVMVLLGCGALSSTCGQLASYPLALVRTRMQAQAMLEGSPQLNMVGLFRRIISKEGIPGLYRGITPNFMKVLPAVGISYVVYENMKQTLGVTQK

SEQ ID NO: 14204 - protein, 482 aa, Artificial Sequence
  Description of Artificial Sequence: Synthetic coding sequence
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTLSSAGFSAWIKDSTAEQNRSKTTVLARRSGSHLKSQHFGRPKWADHEVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQGWSTVARFQITATSAFQVQAILLPQPPE

SEQ ID NO: 14205 - protein, 468 aa, Artificial Sequence
  Description of Artificial Sequence: Synthetic coding sequence
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 14206 - protein, 438 aa, Artificial Sequence
  Description of Artificial Sequence: Synthetic coding sequence
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQDVSVYKTDTVPTLIELTGRRGRKMLNKSFWN

SEQ ID NO: 14207 - protein, 229 aa, Artificial Sequence
  Description of Artificial Sequence: Synthetic coding sequence
MWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 14208 - protein, 123 aa, Artificial Sequence
  Description of Artificial Sequence: Synthetic coding sequence
MEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQAGGHAMSSLMERTMW

SEQ ID NO: 14209 - protein, 477 aa, Artificial Sequence; identical to SEQ ID NO: 14203
  Description of Artificial Sequence: Synthetic coding sequence

SEQ ID NO: 14210 - protein, 458 aa, Artificial Sequence
  Description of Artificial Sequence: Synthetic coding sequence
MDSLYGDLFWYLDYNKDGTLDIFELQEGLEDVGAIQSLEEAKKIFTTGDVNKDGKLDFEEFMKYLKDHEKKMKLAFKSLDKNNDGKIEASEIVQSLQTLGLTISEQQAELILQSIDVDGTMTVDWNEWRDYFLFNPVTDIEEIIRFWKHSTGIDIGDSLTIPDEFTEDEKKSGQWWRQLLAGGIAGAVSRTSTAPLDRLKIMMQVHGSKSDKMNIFGGFRQMVKEGGIRSLWRGNGTNVIKIAPETAVKFWAYEQYKKLLTEEGQKIGTFERFISGSMAGATAQTFIYPMEVMKTRLAVGKTGQYSGIYDCAKKILKHEGLGAFYKGYVPNLLGIIPYAGIDLAVYELLKSYWLDNFAKDSVNPGVMVLLGCGALSSTCGQLASYPLALVRTRMQAQAMLEGSPQLNMVGLFRRIISKEGIPGLYRGITPNFMKVLPAVGISYVVYENMKQTLGVTQK

SEQ ID NO: 14211 - protein, 469 aa, Artificial Sequence
  Description of Artificial Sequence: Synthetic coding sequence
MLCLCLYVPVIGEAQTEFQYFESKGLPAELKSIFKLSVFIPSQEFSTYRQWKQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 14212 - protein, 501 aa, Artificial Sequence
  Description of Artificial Sequence: Synthetic coding sequence
MLQMLWHFLASFFPRAGCHGSREGDDREVRGTPAPAWRDQMASFLGKQDGRAEATEKRPTILLVVGPAEQFPKKIVQAGDKDLDGQLDFEEFVHYLQDHEKKLRLVFKSLDKKNDGRIDAQEIMQSLRDLGVKISEQQAEKILKRIRTGHFWGPVTYMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 14213 - protein, 503 aa, Artificial Sequence
  Description of Artificial Sequence: Synthetic coding sequence
MVSSVLCRCVASPPPDAAATAASSSASSPASVGDPCGGAICGGPDHRLRLWRLFQTLDVNRDGGLCVNDLAVGLRRLGLHRTEGELQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 14214 - protein, 515 aa, Artificial Sequence
  Description of Artificial Sequence: Synthetic coding sequence
MVSSVLCRCVASPPPDAAATAASSSASSPASVGDPCGGAICGGPDHRLRLWRLFQTLDVNRDGGLCVNDLAVGLRRLGLHRTEGELQKIVQAGDKDLDGQLDFEEFVHYLQDHEKKLRLVFKSLDKKNDGRIDAQEIMQSLRDLGVKISEQQAEKILKRIRTGHFWGPVTYMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 14215 - protein, 489 aa, Artificial Sequence
  Description of Artificial Sequence: Synthetic coding sequence
MLQMLWHFLASFFPRAGCHGSREGDDREVRGTPAPAWRDQMASFLGKQDGRAEATEKRPTILLVVGPAEQFPKKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 14216 - protein, 366 aa, Artificial Sequence
  Description of Artificial Sequence: Synthetic coding sequence
MQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 14217 - protein, 297 aa, Artificial Sequence; identical to SEQ ID NO: 11822
  Description of Artificial Sequence: Synthetic coding sequence

SEQ ID NO: 14218 - protein, 303 aa, Artificial Sequence
  Description of Artificial Sequence: Synthetic coding sequence
MALDFLAGCAGGVAGVLVGHPFDTVKVRLQVQSVEKPQYRGTLHCFKSIIKQESVLGLYKGLGSPLMGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLAGGTSGIVSWLSTYPVDVVKSRLQADGLRGAPRYRGILDCVHQSYRAEGWRVFTRGLASTLLRAFPVNAATFATVTVVLTYARGEEAGPEGEAVPAAPAGPALAQPSSL

SEQ ID NO: 14219 - protein, 237 aa, Artificial Sequence
  Description of Artificial Sequence: Synthetic coding sequence
MGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLAGGTSGIVSWLSTYPVDVVKSRLQADGLRGAPRYRGILDCVHQSYRAEGWRVFTRGLASTLLRAFPVNAATFATVTVVLTYARGEEAGPEGEAVPAAPAGPALAQPSSL

SEQ ID NO: 14220 - protein, 237 aa, Artificial Sequence; identical to SEQ ID NO: 14219
  Description of Artificial Sequence: Synthetic coding sequence

SEQ ID NO: 14221 - protein, 237 aa, Artificial Sequence; identical to SEQ ID NO: 14219
  Description of Artificial Sequence: Synthetic coding sequence

SEQ ID NO: 14222 - protein, 237 aa, Artificial Sequence; identical to SEQ ID NO: 14219
  Description of Artificial Sequence: Synthetic coding sequence

SEQ ID NO: 14223 - protein, 311 aa, Artificial Sequence
  Description of Artificial Sequence: Synthetic coding sequence
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHEVVRTRLREEGTKYRSFFQTLSLLVQEEGYGSLYRGLTTHLVRQIPNTAIMMATYELVVYLLNG

SEQ ID NO: 14224 - protein, 310 aa, Artificial Sequence
  Description of Artificial Sequence: Synthetic coding sequence
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHVVRTRLREEGTKYRSFFQTLSLLVQEEGYGSLYRGLTTHLVRQIPNTAIMMATYELVVYLLNG

SEQ ID NO: 14225 - protein, 308 aa, Artificial Sequence
  Description of Artificial Sequence: Synthetic coding sequence
MDFVAGAIGGVCGVAVGYPLDTVKVRIQTEPKYTGIWHCVRDTYHRERVWGFYRGLSLPVCTVSLVSSVSFGTYRHCLAHICRLRYGNPDAKPTKADITLSGCASGLVRVFLTSPTEVAKVRLQTQTQAQKQQRRLSASGPLAVPPMCPVPPACPEPKYRGPLHCLATVAREEGLCGLYKGSSALVLRDGHSFATYFLSYAVLCEWLSPAGHSRPDVPGVLVAGGCAGVLAWAVATPMDVIKSRLQADGQGQRRYRGLLHCMVTSVREEGPRVLFKGLVLNCCRAFPVNMVVFVAYEAVLRLARGLLT

SEQ ID NO: 14226 - protein, 291 aa, Artificial Sequence
  Description of Artificial Sequence: Synthetic coding sequence
MGSFQLEDFAAGWIGGAASVIVGHPLDTVKTRLQAGVGYGNTLSCIRVVYRRESMFGFFKGMSFPLASIAVYNSVVFGVFSNTQRFLSQHRCGEPEASPPRTLSDLLLASMVAGVVSVGLGGPVDLIKIRLQMQTQPFRDANLGLKSRAVAPAEQPAYQGPVHCITTIVRNEGLAGLYRGASAMLLRDVPGYCLYFIPYVFLSEWITPEACTGPSPCAVWLAGGMAGKGSSSWSRTPVQATAVGQLGNCHALLSPGGGQDTFRYSPNNSLLGTYSVPGPLPPQSHPFPMQL

SEQ ID NO: 14227 - protein, 157 aa, Artificial Sequence
  Description of Artificial Sequence: Synthetic coding sequence
MGSFQLEDFAAGWIGGAASVIVGHPLDTVKTRLQAGVGYGNTLSCIRVVYRRESMFGFFKGMSFPLASIAVYNSVVFGVFSNTQRFLSQHRCGEPEASPPRTLSDLLLASMVAGVVSVGLGGPVDLIKIRLQMQTQPFRDGGEHRMTTVFPGPHLCM

SEQ ID NO: 14228 - protein, 311 aa, Artificial Sequence
  Description of Artificial Sequence: Synthetic coding sequence
MGSFQLEDFAAGWIGGAASVIVGHPLDTVKTRLQAGVGYGNTLSCIRVVYRRESMFGFFKGMSFPLASIAVYNSVVFGVFSNTQRFLSQHRCGEPEASPPRTLSDLLLASMVAGVVSVGLGGPVDLIKIRLQMQTQPFRDANLGLKSRAVAPAEQPAYQGPVHCITTIVRNEGLAGLYRGASAMLLRDVPGYCLYFIPYVFLSEWITPEACTGPSPCAVWLAGGMAGAISWGTATPMDVVKSRLQADGVYLNKYKGVLDCISQSYQKEGLKVFFRGITVNAVRGFPMSAAMFLGYELSLQAIRGDHAVTSP

SEQ ID NO: 14229 - protein, 257 aa, Artificial Sequence
  Description of Artificial Sequence: Synthetic coding sequence
MFGFFKGMSFPLASIAVYNSVVFGVFSNTQRFLSQHRCGEPEASPPRTLSDLLLASMVAGVVSVGLGGPVDLIKIRLQMQTQPFRDANLGLKSRAVAPAEQPAYQGPVHCITTIVRNEGLAGLYRGASAMLLRDVPGYCLYFIPYVFLSEWITPEACTGPSPCAVWLAGGMAGAISWGTATPMDVVKSRLQADGVYLNKYKGVLDCISQSYQKEGLKVFFRGITVNAVRGFPMSAAMFLGYELSLQAIRGDHAVTSP

SEQ ID NO: 14230 - protein, 701 aa, Artificial Sequence
  Description of Artificial Sequence: Synthetic coding sequence
MDESPEPLQQGRGPVPVRRQRPAPRGLREMLKARLWCSCSCSVLCVRALVQDLLPATRWLRQYRPREYLAGDVMSGLVIGIILVPQAIAYSLLAGLQPIYSLYTSFFANLIYFLMGTSRHVSVGIFSLLCLMVGQVVDRELQLAGFDPSQDGLQPGANSSTLNGSAAMLDCGRDCYAIRVATALTLMTGLYQVLMGVLRLGFVSAYLSQPLLDGFAMGASVTILTSQLKHLLGVRIPRHQGPGMVVLTWLSLLRGAGQANVCDVVTSTVCLAVLLAAKELSDRYRHRLRVPLPTELLVIVVATLVSHFGQLHKRFGSSVAGDIPTGFMPPQVPEPRLMQRVALDAVALALVAAAFSISLAEMFARSHGYSVRANQELLAVGCCNVLPAFLHCFATSAALAKSLVKTATGCRTQLSSVVSATVVLLVLLALAPLFHDLQRSVLACVIVVSLRGALRKVWDLPRLWRMSPADALVWAGTAATCMLVSTEAGLLAGVILSLLSLAGRTQRPRTALLARIGDTAFYEDATEFEGLVPEPGVRVFRFGGPLYYANKDFFLQSLYSLTGLDAGCMAARRKEGGSETGVGEGGPAQGEDLGPVSTRAALVPAAAGFHTVVIDCAPLLFLDAAGVSTLQDLRRDYGALGISLLLACCSPPVRDILSRGGFLGEGPGDTAEEEQLFLSVHDAVQTARARHRELEATDAHL

SEQ ID NO: 14231 - protein, 701 aa, Artificial Sequence; identical to SEQ ID NO: 14230
  Description of Artificial Sequence: Synthetic coding sequence

SEQ ID NO: 14232 - protein, 224 aa, Artificial Sequence
  Description of Artificial Sequence: Synthetic coding sequence
MDESPEPLQQGRGPVPVRRQRPAPRGLREMLKARLWCSCSCSVLCVRALVQDLLPATRWLRQYRPREYLAGDVMSGLVIGIILVPQAIAYSLLAGLQPIYSLYTSFFANLIYFLMGTSRHVSVGIFSLLCLMVGQVVDRELQLAGFDPSQDGLQPGANSSTLNGSAAMLDCGRDCYAIRVATALTLMTGLYQTSWGRNSFQQHPWQLTQRSDSQELLEEEERSC

SEQ ID NO: 14233 - protein, 454 aa, Artificial Sequence
  Description of Artificial Sequence: Synthetic coding sequence
MRLDLASLMSAPKSLGSAFKSWRLDKAPSPQHTFPSTSIPGMAFALLASVPPVFGLYTSFFPVLIYSLLGTGRHLSTGTFAILSLMTGSAVERLVPEPLVGNLSGIEKEQLDAQRVGVAAAVAFGSGALMLGMFVLQLGVLSTFLSEPVVKALTSGAALHVLLSQLPSLLGLSLPRQIGCFSLFKTLASLLTALPRSSPAELTISALSLALLVPVKELNVRFRDRLPTPIPGEVVLVLLASVLCFTSSVDTRYQVQIVGLLPGGFPQPLLPNLAELPRILADSLPIALVSFAVSASLASIHADKYSYTIDSNQEFLAHGASNLISSLFSCFPNSATLATTNLLVDAGGKTQLAGLFSCTVVLSVLLWLGPFFYYLPKAVLACINISSMRQVFCQMQELPQLWHISRVDFAVWMVTWVAVVTLSVDLGLAVGVVFSMMTVVCRTRSSSRSRGSAS

SEQ ID NO: 14234 - protein, 606 aa, Artificial Sequence
  Description of Artificial Sequence: Synthetic coding sequence
MPSSVTALGQARSSGPGMAPSACCCSPAALQRRLPILAWLPSYSLQWLKMDFVAGLSVGLTAIPQALAYAEVAGLPPQYGLYSAFMGCFVYFFLGTSRDVTLGPTAIMSLLVSFYTFHEPAYAVLLAFLSGCIQLAMGVLRLGFLLDFISYPVIKGFTSAAAVTIGFGQIKNLLGLQNIPRPFFLQVYHTFLRIAETRVGDAVLGLVCMLLLLVLKLMRDHVPPVHPEMPPGVRLSRGLVWAATTARNALVVSFAALVAYSFEVTGYQPFILTGETAEGLPPVRIPPFSVTTANGTISFTEMVQDMGAGLAVVPLMGLLESIAVAKAFASQNNYRIDANQELLAIGLTNMLGSLVSSYPVTGSFGRTAVNAQSGVCTPAGGLVTGVLVLLSLDYLTSLFYYIPKSALAAVIIMAVAPLFDTKIFRTLWRVKRLDLLPLCVTFLLCFWEVQYGILAGALVSLLMLLHSAARPETKVSEGPVLVLQPASGLSFPAMEALREEILSRALEVSPPRCLVLECTHVCSIDYTVVLGLGELLQDFQKQGVALAFVGLQVPVLRVLLSADLKGFQYFSTLEEAEKHLRQEPGTQPYNIREDSILDQKVALLKA

SEQ ID NO: 14235 - protein, 606 aa, Artificial Sequence; identical to SEQ ID NO: 14234
  Description of Artificial Sequence: Synthetic coding sequence

SEQ ID NO: 14236 - protein, 606 aa, Artificial Sequence; identical to SEQ ID NO: 14234
  Description of Artificial Sequence: Synthetic coding sequence

SEQ ID NO: 14237 - protein, 656 aa, Artificial Sequence
  Description of Artificial Sequence: Synthetic coding sequence
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGHHVATGTFALTSLISANAVERIVPQNMQNLTTQSNTSVLGLSDFEMQRIHVAAAVSFLGGVIQVAMFVLQLGSATFVVTEPVISAMTTGAATHVVTSQVKYLLGMKMPYISGPLGFFYIYAYVFENIKSVRLEALLLSLLSIVVLVLVKELNEQFKRKIKVVLPVDLVLIIAASFACYCTNMENTYGLEVVGHIPQGIPSPRAPPMNILSAVITEAFGVALVGYVASLALAQGSAKKFKYSIDDNQEFLAHGLSNIVSSFFFCIPSAAAMGRTAGLYSTGAKTQVACLISCIFVLIVIYAIGPLLYWLPMCVLASIIVVGLKGMLIQFRDLKKYWNVDKIDWGIWVSTYVFTICFAANVGLLFGVVCTIAIVIGRFPRAMTVSIKNMKEMEFKVKTEMDSETLQQVKIISINNPLVFLNAKKFYTDLMNMIQKENACNQPLDDISKCEQNTLLNSLSNGNCNEEASQSCPNEKCYLILDCSGFTFFDYSGVSMLVEVYMDCKGRSVDVLLAHCTASLIKAMTYYGNLDSEKPIFFESVSAAISHIHSNKNLSKLSDHSEV

SEQ ID NO: 14238 - protein, 663 aa, Artificial Sequence
  Description of Artificial Sequence: Synthetic coding sequence
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGHHVATGTFALTSLISANAVERIVPQNMQNLTTQSNTSVLGLSDFEMQRIHVAAAVSFLGGVIQVAMFVLQLGSATFVVTEPVISAMTTGAATHVVTSQVKYLLGMKMPYISGPLGFFYIYAYVFENIKSVRLEALLLSLLSIVVLVLVKELNEQFKRKIKVVLPVDLVLIIAASFACYCTNMENTYGLEVVGHIPQGIPSPRAPPMNILSAVITEAFGVALVGYVASLALAQGSAKKFKYSIDDNQEFLAHGLSNIVSSFFFCIPSAAAMGRTAGLYSTGAKTQVACLISCIFVLIVIYAIGPLLYWLPMCVLASIIVVGLKGMLIQFRDLKKYWNVDKIDWGIWVSTYVFTICFAANVGLLFGVVCTIAIVIGRFPRAMTVSIKNMKEMEFKVKTEMDSETLQQVKIISINNPLVFLNAKKFYTDLMNMIQKENACNQPLDDISKCEQNTLLNSLSNGNCNEEASQSCPNEKCYLILDCSGFTFFDYSGVSMLVEVYMDCKGRSVDVLLAHCTASLIKAMTYYGNLDSEKPIFFESVSAAISHIHSNKASYKLLFDNLDLPTMPPL

SEQ ID NO: 14239 - protein, 207 aa, Artificial Sequence
  Description of Artificial Sequence: Synthetic coding sequence
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGHHVATGTFALTSLISANAVERIVPQNMQNLTTQSNTSVLGLSDFEMQRIHVAAAVSFLGGVIQVAMFVLQLGSATFVVTEPVISAMTTGAATHVVTSQVKYLLGMKMPYIS

SEQ ID NO: 14240 - protein, 656 aa, Artificial Sequence; identical to SEQ ID NO: 14237
  Description of Artificial Sequence: Synthetic coding sequence

SEQ ID NO: 14241 - protein, 970 aa, Artificial Sequence
  Description of Artificial Sequence: Synthetic coding sequence
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQLIMGVLGLGFIATYLPESAMSAYLAAVALHIMLSQLTFIFGIMISFHAGPISFFYDIINYCVALPKANSTSILVFLTVVVALRINKCIRISFNQYPIEFPMELFLIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 14242 - protein, 865 aa, Artificial Sequence
  Description of Artificial Sequence: Synthetic coding sequence
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 14243 - protein, 970 aa, Artificial Sequence; identical to SEQ ID NO: 14241
  Description of Artificial Sequence: Synthetic coding sequence

SEQ ID NO: 14244 - protein, 887 aa, Artificial Sequence
  Description of Artificial Sequence: Synthetic coding sequence
MSQPRPRYVVDRAAYSLTLFDDEFEKKDRTYPVGEKLRNAFRCSSAKIKAVVFGLLPVLSWLPKYKIKDYIIPDLLGGLSGGSIQVPQGMAFALLANLPAVNGLYSSFFPLLTYFFLGGVHQMVPGTFAVISILVGNICLQLAPESKFQVFNNATNESYVDTAAMEAERLHVSATLACLTAIIQMGLGFMQFGFVAIYLSESFIRGFMTAAGLQILISVLKYIFGLTIPSYTGPGSIVFTFIDICKNLPHTNIASLIFALISGAFLVLVKELNARYMHKIRFPIPTEMIVVVVATAISGGCKMPKKYHMQIVGEIQRGFPTPVSPVVSQWKDMIGTAFSLAIVSYVINLAMGRTLANKHGYDVDSNQEMIALGCSNFFGSFFKIHVICCALSVTLAVDGAGGKSQVASLCVSLVVMITMLVLGIYLYPLPKSVLGALIAVNLKNSLKQLTDPYYLWRKSKLDCCIWVVSFLSSFFLSLPYGVAVGVAFSVLVVVFQTQFRNGYALAQVMDTDIYVNPKTYNRAQDIQGIKIITYCSPLYFANSEIFRQKVIAKTGMDPQKVLLAKQKYLKKQEKRRMRPTQQRRSLFMKTKTVSLQELQQDFENAPPTDPNNNQTPANGTSVSYITFSPDSSSPAQSEPPASAEAPGEPSDMLASVPPFVTFHTLILDMSGVSFVDLMGIKALAKLSSTYGKIGVKVFLVNIHAQVYNDISHGGVFEDGSLECKHVFPSIHDAVLFAQANARDVTPGHNFQGAPGDAELSLYDSEEDIRSYWDLEQEMFGSMFHAETLTALESLSAAGGCYPYRSESLVSPLFTRQALAAMDKPPAHSTPPTSALSLAAEGHLDFQLLRVSQKQKDKYNCAGLLYKLQKVSQSPHGSVSDGVRLSRT

SEQ ID NO: 14245 - protein, 887 aa, Artificial Sequence; identical to SEQ ID NO: 14244
  Description of Artificial Sequence: Synthetic coding sequence

SEQ ID NO: 14246 - protein, 791 aa, Artificial Sequence
  Description of Artificial Sequence: Synthetic coding sequence
MSQPRPRYVVDRAAYSLTLFDDEFEKKDRTYPVGEKLRNAFRCSSAKIKAVVFGLLPVLSWLPKYKIKDYIIPDLLGGLSGGSIQVPQGMAFALLANLPAVNGLYSSFFPLLTYFFLGGVHQMVPGTFAVISILVGNICLQLAPESKFQVFNNATNESYVDTAAMEAERLHVSATLACLTAIIQMGLGFMQFGFVAIYLSESFIRGFMTAAGLQILISVLKYIFGLTIPSYTGPGSIVFTFIDICKNLPHTNIASLIFALISGAFLVLVKELNARYMHKIRFPIPTEMIVVVVATAISGGCKMPKKYHMQIVGEIQRGFPTPVSPVVSQWKDMIGTAFSLAIVSYVINLAMGRTLANKHGYDVDSNQEMIALGCSNFFGSFFKIHVICCALSVTLAVDGAGGKSQVASLCVSLVVMITMLVLGIYLYPLPKSVLGALIAVNLKNSLKQLTDPYYLWRKSKLDCCIWVVSFLSSFFLSLPYGVAVGVAFSVLVVVFQTQFRNGYALAQVMDTDIYVNPKTYNRAQDIQGIKIITYCSPLYFANSEIFRQKVIAKTGMDPQKVLLAKQKYLKKQEKRRMRPTQQRRSLFMKTKTVSLQELQQDFENAPPTDPNNNQTPANGTSVSYITFSPDSSSPAQSEPPASAEAPGEPSDMLASVPPFVTFHTLILDMSGVSFVDLMGIKALAKLSSTYGKIGVKVFLVNIHAQVYNDISHGGVFEDGSLECKHVFPSIHDAVLFAQANARDVTPGHNFQGAPGDAELSLYDSEEDIRSYWDLEQEMFGSMFHAETLTAL

SEQ ID NO: 14247 - protein, 619 aa, Artificial Sequence
  Description of Artificial Sequence: Synthetic coding sequence
MLLSWLTVLGAGMVVLHFLQKLLFPYFWDDFWFVLKVVLIIIRLKKYEKRGELVTVLDKFLSHAKRQPRKPFIIYEGDIYTYQDVDKRSSRVAHVFLNHSSLKKGDTVALLMSNEPDFVHVWFGLAKLGCVVAFLNTNIRSNSLLNCIRACGPRALVVGADLLGTVEEILPSLSENISVWGMKDSVPQGVISLKEKLSTSPDEPVPRSHHVVSLLKSTCLYIFTSGTTGLPKAAVISQLQVLRGSAVLWAFGCTAHDIVYITLPLYHSSAAILGISGCVELGATCVLKKKFSASQFWSDCKKYDVTVFQYIGELCRYLCKQSKREGEKDHKVRLAIGNGIRSDVWREFLDRFGNIKVCELYAATESSISFMNYTGRIGAIGRTNLFYKLLSTFDLIKYDFQKDEPMRNEQGWCIHVKKGEPGLLISRVNAKNPFFGYAGPYKHTKDKLLCDVFKKGDVYLNTGDLIVQDQDNFLYFWDRTGDTFRWKGENVATTEVADVIGMLDFIQEANVYGVAISGYEGRAGMASIILKPNTSLDLEKVYEQVVTFLPAYACPRFLRIQEKMEATGTFKLLKHQLVEDGFNPLKISEPLYFMDNLKKSYVLLTRELYDQIMLGEIKL

SEQ ID NO: 14248 - protein, 619 aa, Artificial Sequence; identical to SEQ ID NO: 14247
  Description of Artificial Sequence: Synthetic coding sequence

SEQ ID NO: 14249 - protein, 619 aa, Artificial Sequence; identical to SEQ ID NO: 14247
  Description of Artificial Sequence: Synthetic coding sequence

SEQ ID NO: 14250 - protein, 530 aa, Artificial Sequence
  Description of Artificial Sequence: Synthetic coding sequence
MGSVGSQRLEEPSVAGTPDPGVVMSFTFDSHQLEEAAEAAQGQGLRARGVPAFTDTTLDEPVPDDRYHAIYFAMLLAGVGFLLPYNSFITDVDYLHHKYPGTSIVFDMSLTYILVALAAVLLNNVLVERLTLHTRITAGYLLALGPLLFISICDVWLQLFSRDQAYAINLAAVGTVAFGCTVQQSSFYGYTGMLPKRYTQGVMTGESTAGVMISLSRILTKLLLPDERASTLIFFLVSVALELLCFLLHLLVRRSRFVLFYTTRPRDSHRGRPGLGRGYGYRVHHDVVAGDVHFEHPAPALAPNESPKDSPAHEVTGSGGAYMRFDVPRPRVQRSWPTFRALLLHRYVVARVIWADMLSIAVTYFITLCLFPGLESEIRHCILGEWLPILIMAVFNLSDFVGKILAALPVDWRGTHLLACSCLRVVFIPLFILCVYPSGMPALRHPAWPCIFSLLMGISNGYFGSVPMILAAGKVSPKQRELAGNTMTVSYMSGLTLGSAVAYCTYSLTRDAHGSCLHASTANGSILAGL

SEQ ID NO: 14251 - protein, 530 aa, Artificial Sequence; identical to SEQ ID NO: 14250
  Description of Artificial Sequence: Synthetic coding sequence

SEQ ID NO: 14252 - protein, 163 aa, Artificial Sequence
  Description of Artificial Sequence: Synthetic coding sequence
MGSVGSQRLEEPSVAGTPDPGVVMSFTFDSHQLEEAAEAAQGQGLRARGVPAFTDTTLDEPVPDDRYHAIYFAMLLAGVGFLLPYNSFITDVDYLHHKYPGTSIVFDMSLTYILVALAAVLLNNVLVERLTLHTRITAGYLLALGPLLFISICDVWLQLFSRD

SEQ ID NO: 14253 - protein, 568 aa, Artificial Sequence
  Description of Artificial Sequence: Synthetic coding sequence
MLPGLAAAAAHRCSWSSLCRLRLRCRAAACNPSDRQEWQNLVTFGSFSNMVPCSHPYIGTLSQVKLYSTNVQKEGQGSQTLRVEKVPSFETAEGIGTELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHPYGFSNMRYISSLISGVGIFMMGAGLSWYHGVMGLLHPQPIESLLWAYCILAGSLVSEGATLLVAVNELRRNARAKGMSFYKYVMESRDPSTNVILLEDTAAVLGVIIAATCMGLTSITGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQEIQEVKTPEELETFMLKHGENIIDTLGAEVDRLEKELKKRNPEVRHVDLEIL

SEQ ID NO: 14254 - protein, 396 aa, Artificial Sequence
  Description of Artificial Sequence: Synthetic coding sequence
MWKQNLWKFGEALKLLPEKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHPYGFSNMRYISSLISGVGIFMMGAGLSWYHGVMGLLHPQPIESLLWAYCILAGSLVSEGATLLVAVNELRRNARAKGMSFYKYVMESRDPSTNVILLEDTAAVLGVIIAATCMGLTSITGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQEIQEVKTPEELETFMLKHGENIIDTLGAEVDRLEKELKKRNPEVRHVDLEIL

SEQ ID NO: 14255 - protein, 525 aa, Artificial Sequence
  Description of Artificial Sequence: Synthetic coding sequence
MATLLRSKLSNVATSVSNKSQAKMSGMFARMGFQAATDEEAVGFAHCDDLDFEHRQGLQMDILKAEGEPCGDEGAEAPVEGDIHYQRGSGAPLPPSGSKDQVGGGGEFGGHDKPKITAWEAGWNVTNAIQGMFVLGLPYAILHGGYLGLFLIIFAAVVCCYTGKILIACLYEENEDGEVVRVRDSYVAIANACCAPRFPTLGGRVVNVAQIIELVMTCILYVVVSGNLMYNSFPGLPVSQKSWSIIATAVLLPCAFLKNLKAVSKFSLLCTLAHFVINILVIAYCLSRARDWAWEKVKFYIDVKKFPISIGIIVFSYTSQIFLPSLEGNMQQPSEFHCMMNWTHIAACVLKGLFALVAYLTWADETKEVITDNLPGSIRAVVNIFLVAKALLSYPLPFFAAVEVLEKSLFQEGSRAFFPACYSGDGRLKSWGLTLRCALVVFTLLMAIYVPHFALLMGLTGSLTGAGLCFLLPSLFHLRLLWRKLLWHQVFFDVAIFVIGGICSVSGFVHSLEGLIEAYRTNAED

SEQ ID NO: 14256 - protein, 410 aa, Artificial Sequence
  Description of Artificial Sequence: Synthetic coding sequence
MAAAAVGAGHGAGGPGAASSSGGAREGARVAALCLLWYALSAGGNVVNKVILSAFPFPVTVSLCHILALCAGLPPLLRAWRVPPAPPVSGPGPSPHPSSGPLLPPRFYPRYVLPLAFGKYFASVSAHVSIWKVPVSYAHTVKATMPIWVVLLSRIIMKEKQSTKVYLSLIPIISGVLLATVTELSFDMWGLVSALAATLCFSLQNIFSKKVLRDSRIHHLRLLNILGCHAVFFMIPTWVLVDLSAFLVSSDLTYVYQWPWTLLLLAVSGFCNFAQNVIAFSILNLVSPLSYSVANATKRIMVITVSLIMLRNPVTSTNVLGMMTAILGVFLYNKTKYDANQQARKHLLPVTTADLSSKERHRSPLEKPHNGLLFPQHGDYQYGRNNILTDHFQYSRQSYPNSYSLNRYDV

SEQ ID NO: 14257 - protein, 485 aa, Artificial Sequence
  Description of Artificial Sequence: Synthetic coding sequence
MDVKAAPNGVATIEDRILRITGYYGYYPGYSSQKSTSRSSVTRCKPGANCPSSHSGISRQLSPLSVTEDSSAPILELQNQGSSGVCGHRVERQNRSADDGTQTHSENSSQENRIKARCLSCTSMVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPVILYFTKVEHWSSFAALPWGCLCGMAGLWLAFNILVNVGVVLTYPILISIGTVLSVPGNAAVDLLKQEVIFNVVRLAATIIICIGFLLMLLPEEWDEITLRFINSLKEKKSEEHVDDVTDPSIHLRGRGRANGTVSIPLA

SEQ ID NO: 14258 - protein, 324 aa, Artificial Sequence
  Description of Artificial Sequence: Synthetic coding sequence
MSVEDGGMPGLGRPRQARWTLMLLLSTAMYGAHAPLLALCHVDGRVPFRPSSAVLLTELTKLLLCAFSLLVGWQAWPQGPPPWRQAAPFALSALLYGANNNLVIYLQRYMDPSTYQVLSNLKIGSTAVLYCLCLRHRLSVRQGLALLLLMAAGACYAAGGLQVPGNTLPSPPPAAAASPMPLHITPLGLLLLILYCLISGLSSVYTELLMKRQRLPLALQNLFLYTFGVLLNLGLHAGGGSGPGLLEGFSGWAALVVLSQALNGLLMSAVMKHGSSITRLFVVSCSLVVNAVLSAVLLRLQLTAAFFLATLLIGLAMRLYYGSR

SEQ ID NO: 14259 - protein, 178 aa, Artificial Sequence
  Description of Artificial Sequence: Synthetic coding sequence
MPLILSILSGNVPRLLLPGSWLHNLIFPKRVAIPAAPGTSEPLPLHFWCASESRSACWRRLWPRPPGRFLRMGSTRGAEPGTKWTAHVCCHEAWQQHHTPLCGVLLAGGQRRALSSPATAAAHSRLLPGHIAHWPGHAPVLWQPLVPDNFHPDSGPCRLGATTRSPSQAFLPLPSAAL

SEQ ID NO: 14260 - protein, 324 aa, Artificial Sequence; identical to SEQ ID NO: 14258
  Description of Artificial Sequence: Synthetic coding sequence

SEQ ID NO: 14261 - protein, 88 aa, Artificial Sequence
  Description of Artificial Sequence: Synthetic coding sequence
MEKQCCSHPVICSLSTMYTFLLGAIFIALSSSRILLVKYSANEENKYDYLPTTVNVCSELVKLVFCVLVSFCVIKKDHQSRNLKYASW

SEQ ID NO: 14262 - protein, 147 aa, Artificial Sequence
  Description of Artificial Sequence: Synthetic coding sequence
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLN

SEQ ID NO: 14263 - protein, 424 aa, Artificial Sequence
  Description of Artificial Sequence: Synthetic coding sequence
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRSECPRKDNCTAKEWTFPEAKWNTTARVFSHIRLGMGHVLIIVQCFISSMANIYNEKILKEGNQLTESIFIQNSKLYFFGILFNGLTLGLQRSNRDQIKNCGFFYGHSAFSVALIFVTAFQGLSVAFILKFLDNMFHVLMAQVTTVIITTVSVLVFDFRPSLEFFLEAPSVLLSIFIYNASKPQVPEYAPRQERIRDLSGNLWERSSGDGEELERLTKPKSDESDEDTF

SEQ ID NO: 14264 - protein, 365 aa, Artificial Sequence
  Description of Artificial Sequence: Synthetic coding sequence
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 14265 - protein, 344 aa, Artificial Sequence
  Description of Artificial Sequence: Synthetic coding sequence
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 14266 - protein, 158 aa, Artificial Sequence
  Description of Artificial Sequence: Synthetic coding sequence
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLARHWSWWSSSSPGVSSCSPTSPHSSTWRASPWCWGPRSSVAFAGPS

SEQ ID NO: 14267 - protein, 233 aa, Artificial Sequence
  Description of Artificial Sequence: Synthetic coding sequence
MELKRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 14268 - protein, 365 aa, Artificial Sequence; identical to SEQ ID NO: 14264
  Description of Artificial Sequence: Synthetic coding sequence

SEQ ID NO: 14269 - protein, 232 aa, Artificial Sequence [sequence omitted]

SEQ ID NO: 14270 - protein, 365 aa, Artificial Sequence; identical to SEQ ID NO: 14264
  Description of Artificial Sequence: Synthetic coding sequence

SEQ ID NO: 14271 - protein, 196 aa, Artificial Sequence
  Description of Artificial Sequence: Synthetic coding sequence
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLPHSSTWRASPWCWGPRSSVAFAGPSPRCSCRRLNSASRIPSTPCSTCSHSCSWGSSLSLLYLKVSICPHLRKSSVSRTQGCSCG

SEQ ID NO: 14272 - protein, 158 aa, Artificial Sequence; identical to SEQ ID NO: 14266
  Description of Artificial Sequence: Synthetic coding sequence

SEQ ID NO: 14273 - protein, 394 aa, Artificial Sequence
  Description of Artificial Sequence: Synthetic coding sequence
MGRVSTSHQPLRGVPAPADSGAPVLQPPRMGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 14274 - protein, 410 aa, Artificial Sequence; identical to SEQ ID NO: 14256
  Description of Artificial Sequence: Synthetic coding sequence

SEQ ID NO: 14275 - protein, 104 aa, Artificial Sequence
  Description of Artificial Sequence: Synthetic coding sequence
MKEKQSTKVYLSLIPIISGVLLATVTELSFDMWGLVSALAATLCFSLQNIFSKKVLRDSRIHHLRLLNILGCHAVFFMIPTWVLVDLSAFLVSSDLGLPSENVL

SEQ ID NO: 14276 - protein, 266 aa, Artificial Sequence
  Description of Artificial Sequence: Synthetic coding sequence
MSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGRPSDREEREELQLQPGRGAAASDRRSPVPPSERHGVRPHGENLPGDFQVPQALHRVALSMALPCPMLPAS

SEQ ID NO: 14277 - protein, 246 aa, Artificial Sequence
  Description of Artificial Sequence: Synthetic coding sequence
MSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGRPSDREEREELQLQPGRGAAASDRRSPVPPSERHGVRPHGENLPGDFQAQ

SEQ ID NO: 14278 - protein, 246 aa, Artificial Sequence; identical to SEQ ID NO: 14277
  Description of Artificial Sequence: Synthetic coding sequence

SEQ ID NO: 14279 - protein, 405 aa, Artificial Sequence
  Description of Artificial Sequence: Synthetic coding sequence
MSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGLLVNLSLIPVMGGLALCTATEISFNVLGFSAALSTNIMDCLQNVFSKKLLSGDKYRFSAPELQFYTSAAAVAMLVPARVFFTDVPVIGRSGKSFSYNQDVVLLLLTDGVLFHLQSVTAYALMGKISPVTFSVASTVKHALSIWLSVIVFGNKITSLSAVGTALVTVGVLLYNKARQHQQEALQSLAAATGRAPDDTVEPLLPQDPRQHP

SEQ ID NO: 14280 - protein, 405 aa, Artificial Sequence; identical to SEQ ID NO: 14279
  Description of Artificial Sequence: Synthetic coding sequence

SEQ ID NO: 14281 - protein, 313 aa, Artificial Sequence
  Description of Artificial Sequence: Synthetic coding sequence
MALLVDRVRGHWRIAAGLLFNLLVSICIVFLNKWIYVYHGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTYNMFGHFKFCITLFGGYVLFKDPLSINQALGILCTLFGILAYTHFKLSEQEGSRSKLAQRP

SEQ ID NO: 14282 - protein, 234 aa, Artificial Sequence
  Description of Artificial Sequence: Synthetic coding sequence
MCRCPPEHHDGRMTSAEVGAAAGGAQAAGPPEWPPGSPQALRQPGRARVAMAALVWLLAGASMSSLNKWIFTVHGFGRPLLLSALHMLVAALACHRGARRPMPGGTRCRVLLLSLTFGTSMACGNVGLRAVPLDLAQLVTTTTPLFTLALSALLLGRRHHPLQLAAMGPLCLGAACSLAGEFRTPPTGCGFLLAATCLRGLKSVQQSLSFQICKMELMIPMERVRMRSAGQGQE

SEQ ID NO: 14283 - protein, 350 aa, Artificial Sequence
  Description of Artificial Sequence: Synthetic coding sequence
MCRCPPEHHDGRMTSAEVGAAAGGAQAAGPPEWPPGSPQALRQPGRARVAMAALVWLLAGASMSSLNKWIFTVHGFGRPLLLSALHMLVAALACHRGARRPMPGGTRCRVLLLSLTFGTSMACGNVGLRAVPLDLAQLVTTTTPLFTLALSALLLGRRHHPLQLAAMGPLCLGAACSLAGEFRTPPTGCGFLLAATCLRGLKSVQQSALLQEERLDAVTLLYATSLPSFCLLAGAALVLEAGVAPPPTAGDSRLWACILLSCLLSVLYNLASFSLLALTSALTVHVLGNLTVVGNLILSRLLFGSRLSALSYVGIALTLSGMFLYHNCEFVASWAARRGLWRRDQPSKGL

SEQ ID NO: 14284 - protein, 234 aa, Artificial Sequence; identical to SEQ ID NO: 14282
  Description of Artificial Sequence: Synthetic coding sequence

SEQ ID NO: 14285 - protein, 408 aa, Artificial Sequence
  Description of Artificial Sequence: Synthetic coding sequence
MIPPEQPQQQLQPPSPAPPNHVVTTIENLPAEGSGGGGSLSASSRAGVRQRIRKVLNREMLISVALGQVLSLLICGIGLTSKYLSEDFHANTPVFQSFLNYILLFLVYTTTLAVRQGEENLLAILRRRWWKYMILGLIDLEANYLVVKAYQYTTLTSIQLLDCFVIPVVILLSWFFLLIRYKAVHFIGIVVCILGMGCMVGADVLVGRHQGAGENKLVGDLLVLGGATLYGISNVWEEYIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVVDLPTTAQVEPSVTYTSLGQETEEEPHVRVA

SEQ ID NO: 14286 - protein, 226 aa, Artificial Sequence
  Description of Artificial Sequence: Synthetic coding sequence
MALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPVTSIGIDNLGLKLEENLQETHSAVL

SEQ ID NO: 14287 - protein, 327 aa, Artificial Sequence
  Description of Artificial Sequence: Synthetic coding sequence
MLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPVTSIGIDNLGLKLEENLQETHSAVL

SEQ ID NO: 14288 - protein, 374 aa, Artificial Sequence
  Description of Artificial Sequence: Synthetic coding sequence
MEADSPAGPGAPEPLAEGAAAEFSSLLRRIKGKLFTWNILKTIALGQMLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPVTSIGIDNLGLKLEENLQETHSAVL

SEQ ID NO: 14289 - protein, 357 aa, Artificial Sequence
  Description of Artificial Sequence: Synthetic coding sequence
MEADSPAGPGAPEPLAEGAAAEFSSLLRRIKGKLFTWNILKTIALGQMLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKDSTSCPSLSSWWGLSCTAPPLLARPSRLKAACLQSPALGLTTWG

SEQ ID NO: 14290 - protein, 374 aa, Artificial Sequence; identical to SEQ ID NO: 14288
  Description of Artificial Sequence: Synthetic coding sequence

SEQ ID NO: 14291 - protein, 421 aa, Artificial Sequence
  Description of Artificial Sequence: Synthetic coding sequence
MKKHSARVAPLSACNSPVLTLTKVEGEERPRDSPGPAEAQAPAGVEAGGRASRRCWTCSRAQLKKIFWGVAVVLCVCSSWAGSTQLAKLTFRKFDAPFTLTWFATNWNFLFFPLYYVGHVCKSTEKQSVKQRYRECCRFFGDNGLTLKVFFTKAAPFGVLWTLTNYLYLHAIKKINTTDVSVLFCCNKAFVFLLSWIVLRDRFMGVRIVAAILAIAGIVMMTYADGFHSHSVIGIALVVASASMSALYKVLFKLLLGSAKFGEAALFLSILGVFNILFITCIPIILYFTKVEYWSSFDDIPWGNLCGFSVLLLTFNIVLNFGIAVTYPTLMSLGIVLSIPVNAVIDHYTSQIVFNGVRVIAIIIIGLGFLLLLLPEEWDVWLIKLLTRLKVRKKEEPAEGAADLSSGPQSKNRRARPSFAR

SEQ ID NO: 14292 - protein, 490 aa, Artificial Sequence
  Description of Artificial Sequence: Synthetic coding sequence
MGIREFPSGAPRGKSIAVGMRRSPDVSPRRLSDISPQLRQLKYLVVDEAIKEDLKWSRSVEDLTSGPVGLTSIEERILRITGYYGYQPWAASCKREERPRDSPGPAEAQAPAGVEAGGRASRRCWTCSRAQLKKIFWGVAVVLCVCSSWAGSTQLAKLTFRKFDAPFTLTWFATNWNFLFFPLYYVGHVCKSTEKQSVKQRYRECCRFFGDNGLTLKVFFTKAAPFGVLWTLTNYLYLHAIKKINTTDVSVLFCCNKAFVFLLSWIVLRDRFMGVRIVAAILAIAGIVMMTYADGFHSHSVIGIALVVASASMSALYKVLFKLLLGSAKFGEAALFLSILGVFNILFITCIPIILYFTKVEYWSSFDDIPWGNLCGFSVLLLTFNIVLNFGIAVTYPTLMSLGIVLSIPVNAVIDHYTSQIVFNGVRVIAIIIIGLGFLLLLLPEEWDVWLIKLLTRLKVRKKEEPAEGAADLSSGPQSKNRRARPSFAR

SEQ ID NO: 14293 - protein, 521 aa, Artificial Sequence
  Description of Artificial Sequence: Synthetic coding sequence
MDELLLDLFHKLTSGRQLAAGNGLCGISHKEQEVWKPGHNILVKMRKEDKSLVWLIHSTLARYTQVTNFLGTSRSSVTRCKPGANCPSSHSGISRQLSPLSVTEDSSAPILELQNQGSSGVCGHRVERQNRSADDGTQTHSENSSQENRIKARCLSCTSMVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPVILYFTKVEHWSSFAALPWGCLCGMAGLWLAFNILVNVGVVLTYPILISIGTVLSVPGNAAVDLLKQEVIFNVVRLAATIIICIGFLLMLLPEEWDEITLRFINSLKEKKSEEHVDDVTDPSIHLRGRGRANGTVSIPLA

SEQ ID NO: 14294 - protein, 523 aa, Artificial Sequence
  Description of Artificial Sequence: Synthetic coding sequence
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 14295 - protein, 517 aa, Artificial Sequence
  Description of Artificial Sequence: Synthetic coding sequence
MDSSGWRGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 14296 - protein, 364 aa, Artificial Sequence
  Description of Artificial Sequence: Synthetic coding sequence
MRPQDSTGVAELQEPGLPLTDDAPPGATEEPAAAEAAGAPDRGRCWLCLSSPCCSRTEPAKKKAPCPGLGLFYTLLSAFLFSVGSLFVKKVQDVHAVEISAFRCVFQMLVVIPCLIYRKTGFIGPKGQRIFLILRGVLGSTAMMLIYYAYQTMSLADATVITFSSPVFTSIFAWICLKEKYSPWDALFTVFTITGVILIVRPPFLFGSDTSGMEESYSGHLKGTFAAIGSAVFAASTLVILRKMGKSVDYFLSIWYYVVLGLVESVIILSVLGEWSLPYCGLDRLFLIFIGLFGLGGQIFITKALQIEKAGPVAIMKTMDVVFAFIFQIIFFNNVPTWWTVGGALCVVASNVGAAIRKWYQSSK

SEQ ID NO: 14297 - protein, 365 aa, Artificial Sequence
  Description of Artificial Sequence: Synthetic coding sequence
MRPQDSTGVAELQEPGLPLTDDAPPGATEEPAAAEAAGAPDRGRCWLCLSSPCCSRTEPEAKKKAPCPGLGLFYTLLSAFLFSVGSLFVKKVQDVHAVEISAFRCVFQMLVVIPCLIYRKTGFIGPKGQRIFLILRGVLGSTAMMLIYYAYQTMSLADATVITFSSPVFTSIFAWICLKEKYSPWDALFTVFTITGVILIVRPPFLFGSDTSGMEESYSGHLKGTFAAIGSAVFAASTLVILRKMGKSVDYFLSIWYYVVLGLVESVIILSVLGEWSLPYCGLDRLFLIFIGLFGLGGQIFITKALQIEKAGPVAIMKTMDVVFAFIFQIIFFNNVPTWWTVGGALCVVASNVGAAIRKWYQSSK

SEQ ID NO: 14298 - protein, 338 aa, Artificial Sequence
  Description of Artificial Sequence: Synthetic coding sequence
MAGSHPYFNQPDSTHPSPPSAPPSLRWYQRCQPSDATSGLLVALLGGGLPAGFVGPLSRMAYQASNLPSLELLIWRCLFHLPIALLLKLRGDPLLGTPDIRSRAFFCALLNILSIGCAYSAVQVVPAGNAATVRKGSSTVCSAVLTLCLESQGLSGYDWCGLLGCILGLIIIVGPGLWTLQEGTTGVYTALGYVEAFLGGLALSLRLLVYRSLHFPPCLPTVAFLSGLVGLLGSVPGLFVLQAPVLPSDLLSWSCVGAVGILALVSFTCVGYAVTKAHPALVCAVLHSEVVVALILQYYMLHETVAPSDIVAAGVVLGSIAIITAQNLSCERTGRVEE

SEQ ID NO: 14299 - protein, 338 aa, Artificial Sequence
  Description of Artificial Sequence: Synthetic coding sequence
MAGSHPYFNLPDSTHPSPPSAPPSLRWHQRCQPSGATNGLLVALLGGGLPAGFVGPLSRMAYQGSNLPSLELLICRCLFHLPIALLLKLRGDPLLGPPDIRGWACFCALLNVLSIGCAYSAVQVVPAGNAATVRKGSSTVCSAVLTLCLESQGLGGYEWCGLLGSILGLIIILGPGLWTLQEGTTGVYTTLGYVQAFLGGLALSLGLLVYRSLHFPSCLPTVAFLSGLVGLLGCVPGLFVLQTPVLPSDLLSWSCVGAEGILALVSFTCVGYAVTKAHPALVCAVLHSEVVVALILQYYMLHETVALSDIMGAGVVLGSIAIITARNLSCERTGKVEE

SEQ ID NO: 14300 - protein, 385 aa, Artificial Sequence
  Description of Artificial Sequence: Synthetic coding sequence
MRSSLAPGVWFFRAFSRDSWFRGLILLLTFLIYACYHMSRKPISIVKSRLHQNCSEQIKPINDTHSLNDTMWCSWAPFDKDNYKELLGGVDNAFLIAYAIGMFISGVFGERLPLRYYLSAGMLLSGLFTSLFGLGYFWNIHELWYFVVIQVCNGLVQTTGWPSVVTCVGNWFGKGKRGFIMGIWNSHTSVGNILGSLIAGIWVNGQWGLSFIVPGIITAVMGVITFLFLIEHPEDVDCAPPQHHGEPAENQDNPEDPGNSPCSIRESGLETVAKCSKGPCEEPAAISFFGALRIPGVVEFSLCLLFAKLVSYTFLYWLPLYIANVAHFSAKEAGDLSTLFDVGGIIDVPVQLHWPGRDCQLHSDADHLWGPGQWPIRAHHHCCLC

SEQ ID NO: 14301 - protein, 505 aa, Artificial Sequence
  Description of Artificial Sequence: Synthetic coding sequence
MRSSLAPGVWFFRAFSRDSWFRGLILLLTFLIYACYHMSRKPISIVKSRLHQNCSEQIKPINDTHSLNDTMWCSWAPFDKDNYKELLGGVDNAFLIAYAIGMFISGVFGERLPLRYYLSAGMLLSGLFTSLFGLGYFWNIHELWYFVVIQVCNGLVQTTGWPSVVTCVGNWFGKGKRGFIMGIWNSHTSVGNILGSLIAGIWVNGQWGLSFIVPGIITAVMGVITFLFLIEHPEDVDCAPPQHHGEPAENQDNPEDPGNSPCSIRESGLETVAKCSKGPCEEPAAISFFGALRIPGVVEFSLCLLFAKLVSYTFLYWLPLYIANVAHFSAKEAGDLSTLFDVGGIIGGIVAGLVSDYTNGRATTCCVMLILAAPMMFLYNYIGQDGIASSIVMLIICGGLVNGPYALITTAVSADLGTHKSLKGNAKALSTVTAIIDGTGSIGAALGPLLAGLISPTGWNNVFYMLISADVLACLLLCRLVYKEILAWKVSLSRGSGSSMVLTHQ

SEQ ID NO: 14302 - protein, 501 aa, Artificial Sequence
  Description of Artificial Sequence: Synthetic coding sequence
MRSSLAPGVWFFRAFSRDSWFRGLILLLTFLIYACYHMSRKPISIVKSRLHQNCSEQIKPINDTHSLNDTMWCSWAPFDKDNYKELLGGVDNAFLIAYAIGMFISGVFGERLPLRYYLSAGMLLSGLFTSLFGLGYFWNIHELWYFVVIQVCNGLVQTTGWPSVVTCVGNWFGKGKRGFIMGIWNSHTSVGNILGSLIAGIWVNGQWGLSFIVPGIITAVMGVITFLFLIEHPEDVDCAPPQHHGEPAENQDNPEDPGNSPCSIRESGLETVAKCSKGPCEEPAAISFFGALRIPGVVEFSLCLLFAKLVSYTFLYWLPLYIANVAHFSAKEAGDLSTLFDVGGIIGGIVAGLVSDYTNGRATTCCVMLILAAPMMFLYNYIGQDGIASSIVMLIICGGLVNGPYALITTAVSADLGTHKSLKGNAKALSTVTAIIDGTGSIGAALGPLLAGLISPTGWNNVFYMLISADVLACLLLCRLVYKEILAWKVSLSRGSGYKEI

SEQ ID NO: 14303 - protein, 505 aa, Artificial Sequence; identical to SEQ ID NO: 14301
  Description of Artificial Sequence: Synthetic coding sequence

SEQ ID NO: 14304 - protein, 494 aa, Artificial Sequence
  Description of Artificial Sequence: Synthetic coding sequence
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYAFLVTASVQFAGGIVIFFGLLVSPEEIGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIGGTLQGFISDVLQKRAPVLALSLLLAVGSLIGYSRSPNDKSINALLMTVTGFFIGGPSNMISSAISADLGRQELIQRSSEALATVTGIVDGSGSIGAAVGQYLVSLIRDKLGWMWVFYFFILMTSCTIVFISPLIVREIFSLVLRRQAHILRE

SEQ ID NO: 14305 - protein, 443 aa, Artificial Sequence
  Description of Artificial Sequence: Synthetic coding sequence
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYAFLVTASVQFAGGIVIFFGLLVSPEEIGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIVFSVSDPGQARMDVGFLLFHSHDKLYNCVYLAINSEGNILSRAKETGSHIEGVTGARETERTMSATSGPLGLRVCPNLGLSRSSSLILDCQASLNTASHLRC

SEQ ID NO: 14306 - protein, 156 aa, Artificial Sequence
  Description of Artificial Sequence: Synthetic coding sequence
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVTRSCFWSLECLCFGGQHFGSVPSFFCSSVWL

SEQ ID NO: 14307 - protein, 478 aa, Artificial Sequence
  Description of Artificial Sequence: Synthetic coding sequence
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYAFLVTASVQFAGGIVIFFGLLVSPEEIGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIGGTLQGFISDVLQKRAPVLALSLLLAVGSLIGYSRFFIGGPSNMISSAISADLGRQELIQRSSEALATVTGIVDGSGSIGAAVGQYLVSLIRDKLGWMWVFYFFILMTSCTIVFISPLIVREIFSLVLRRQAHILRE

SEQ ID NO: 14308 - protein, 14 aa, Artificial Sequence
  Description of Artificial Sequence: Synthetic coding sequence
MAWPNVFQRGSLLS

SEQ ID NO: 14309 - protein, 237 aa, Artificial Sequence [sequence omitted]

SEQ ID NO: 14310 - protein, 780 aa, Artificial Sequence
  Description of Artificial Sequence: Synthetic coding sequence
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 14311 - protein, 1119 aa, Artificial Sequence
  Description of Artificial Sequence: Synthetic coding sequence
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQAKLRDGQKDAAPRAAGTVKELPKGPEQVPVPDPAREAGGPEERLAEEFPGQSQDVTGGSQDRKKPGKEVAATGTSILKEANWLVAGPGAETGDPRMKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIIGLNPLPDVQVNDLRGALDAQLRQAAGGALQVVHSRQLRQAPGPPEES

SEQ ID NO: 14312 - protein, 384 aa, Artificial Sequence
  Description of Artificial Sequence: Synthetic coding sequence
MKQAGFPLGILLLFWVSYVTDFSLVLLIKGGALSGTDTYQSLVNKTFGFPGYLLLSVLQFLYPFIVDPENVFIGRHFIIGLSTVTFTLPLSLYRNIAKLGKVSLISTGLTTLILGIVMARAISLGPHIPKTEDAWVFAKPNAIQAVGVMSFAFICHHNSFLVYSSLEEPTVAKWSRLIHMSIVISVFICIFFATCGYLTFTGFTQGDLFENYCRNDDLVTFGRFCYGVTVILTYPMECFVTREVIANVFFGGNLSSVFHIVVTVMVITVATLVSLLIDCLGIVLELNGVLCATPLIFIIPSACYLKLSEEPRTHSDKIMSCVMLPIGAVVMVFGFVMAITNTQDCTHGQEMFYCFPDNFSLTNTSESHVQQTTQLSTLNISIFQ

SEQ ID NO: 14313 - protein, 406 aa, Artificial Sequence
  Description of Artificial Sequence: Synthetic coding sequence
MKQAGFPLGILLLFWVSYVTDFSLVLLIKGGALSGTDTYQSLVNKTFGFPGYLLLSVLQFLYPFIAMISYNIIAGDTLSKVFQRIPGVDPENVFIGRHFIIGLSTVTFTLPLSLYRNIAKLGKVSLISTGLTTLILGIVMARAISLGPHIPKTEDAWVFAKPNAIQAVGVMSFAFICHHNSFLVYSSLEEPTVAKWSRLIHMSIVISVFICIFFATCGYLTFTGFTQGDLFENYCRNDDLVTFGRFCYGVTVILTYPMECFVTREVIANVFFGGNLSSVFHIVVTVMVITVATLVSLLIDCLGIVLELNGVLCATPLIFIIPSACYLKLSEEPRTHSDKIMSCVMLPIGAVVMVFGFVMAITNTQDCTHGQEMFYCFPDNFSLTNTSESHVQQTTQLSTLNISIFQ

SEQ ID NO: 14314 - protein, 406 aa, Artificial Sequence; identical to SEQ ID NO: 14313
  Description of Artificial Sequence: Synthetic coding sequence

SEQ ID NO: 14315 - protein, 456 aa, Artificial Sequence
  Description of Artificial Sequence: Synthetic coding sequence
MEASWGSFNAERGWYVSVQQPEEAEAEELSPLLSNELHRQRSPGVSFGLSVFNLMNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGAFVLLIFGILVGNFSLALIIFDWINK

SEQ ID NO: 14316 - protein, 521 aa, Artificial Sequence
  Description of Artificial Sequence: Synthetic coding sequence
MEASWGSFNAERGWYVSVQQPEEAEAEELSPLLSNELHRQRSPGVSFGLSVFNLMNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGGLILSHRLACSGVISAHCNLCLPDSSNPPTSASRVAETTGRDTMEMCTQRKGHARTQQEGNCLQAKGRGLRRTKRVHTLILHFPTSRTVSK

SEQ ID NO: 14317 - protein, 516 aa, Artificial Sequence
  Description of Artificial Sequence: Synthetic coding sequence
GSFNAERGWYVSVQQPEEAEAEELSPLLSNELHRQRSPGVSFGLSVFNLMNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGGLILSHRLACSGVISAHCNLCLPDSSNPPTSASRVAETTGRDTMEMCTQRKGHARTQQEGNCLQAKGRGLRRTKRVHTLILHFPTSRTVSK

SEQ ID NO: 14318 - protein, 487 aa, Artificial Sequence
  Description of Artificial Sequence: Synthetic coding sequence
MSGPRIMYSLLLELHRQRSPGVSFGLSVFNLMNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGGLILSHRLACSGVISAHCNLCLPDSSNPPTSASRVAETTEKEEIPWRCAPRGKATQGHSKKATVYKPREEASGEPNVSTP

SEQ ID NO: 14319 - protein, 561 aa, Artificial Sequence
  Description of Artificial Sequence: Synthetic coding sequence
MANMNSDSRHLGTSEVDHERDPGPMNIQFEPSDLRSKRPFCIEPTNIVNVNHVIQRVSDHASAMNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 14320 - protein, 561 aa, Artificial Sequence; identical to SEQ ID NO: 14319
  Description of Artificial Sequence: Synthetic coding sequence

SEQ ID NO: 14321 - protein, 437 aa, Artificial Sequence
  Description of Artificial Sequence: Synthetic coding sequence
MIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 14322 - protein, 131 aa, Artificial Sequence
  Description of Artificial Sequence: Synthetic coding sequence
MANMNSDSRHLGTSEVDHERDPGPMNIQFEPSDLRSKRPFCIEPTNIVNVNHVIQRVSDHASAMNKRIHYYSRLTTPADKALIAPDHVVPAPEECYVYSPLGSAYKLQSYTEGYGKNTSLVTIFMIWNTMM

SEQ ID NO: 14323 - protein, 37 aa, Artificial Sequence
  Description of Artificial Sequence: Synthetic coding sequence
MANMNSDSRHLGTSEVDHERDPGPMNIQFEPSDLRSK

SEQ ID NO: 14324 - protein, 37 aa, Artificial Sequence; identical to SEQ ID NO: 14323
  Description of Artificial Sequence: Synthetic coding sequence

SEQ ID NO: 14325 - protein, 498 aa, Artificial Sequence
  Description of Artificial Sequence: Synthetic coding sequence
MAICILTWRIRPFCIEPTNIVNVNHVIQRVSDHASAMNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 14326 - protein, 26 aa, Artificial Sequence
  Description of Artificial Sequence: Synthetic coding sequence
MANMNSDSRHLGTSEVDHERDPGPMN

SEQ ID NO: 14327 - protein, 97 aa, Artificial Sequence
  Description of Artificial Sequence: Synthetic coding sequence
MANMNSDSRHLGTSEVDHERDPGPMNIQFEPSDLRSKRPFCIEPTNIVNVNHVIQRVSDHASAMNKRIHYYSRLTTPADKALIAPDHVVPAPEECYV

SEQ ID NO: 14328 - protein, 498 aa, Artificial Sequence
  Description of Artificial Sequence: Synthetic coding sequence
MNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 14329 - protein, 462 aa, Artificial Sequence
  Description of Artificial Sequence: Synthetic coding sequence
MANMNSDSRHLGTSEVDHERDPGPMNIQFEPSDLRSKRPFCIEPTNIVNVNHVIQRVSDHASAMNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQVRHRVPSLCDCVHFHVFIVGRVIQWQDITSDRPGF

SEQ ID NO: 14330 - protein, 335 aa, Artificial Sequence
  Description of Artificial Sequence: Synthetic coding sequence
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTTLALNFGSTLMKKKSDPEGPALLFPESELSIRIDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 14331 - protein, 342 aa, Artificial Sequence
  Description of Artificial Sequence: Synthetic coding sequence
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTTLALNFGSTLMKKKSDPEGPALLFPESELSIRIGRAGLLSDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 14332 - protein, 540 aa, Artificial Sequence
  Description of Artificial Sequence: Synthetic coding sequence
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGALAVGTLCGDALLHLLPHAQEGRHAGPGGLPEKDLGPGLSVLGGLFLLFVLENMLGLLRHRGLRPRCCRRKRRNLETRNLDPENGSGMALQPLQAAPEPGAQGQREKNSQHPPALAPPGHQGHSHGHQGGTDITWMVLLGDGLHNLTDGLAIGAAFSDGFSSGLSTTLAVFCHELPHELGDFAMLLQSGLSFRRLLLLSLVSGALGLGGAVLGVGLSLGPVPLTPWVFGVTAGVFLYVALVDMLPALLRPPEPLPTPHVLLQGLGLLLGGGLMLAITLLEERLLPVTTEG

SEQ ID NO: 14333 - protein, 129 aa, Artificial Sequence
  Description of Artificial Sequence: Synthetic coding sequence
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLP

SEQ ID NO: 14334 - protein, 156 aa, Artificial Sequence
  Description of Artificial Sequence: Synthetic coding sequence
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNE

SEQ ID NO: 14335 - protein, 123 aa, Artificial Sequence
  Description of Artificial Sequence: Synthetic coding sequence
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEES

SEQ ID NO: 14336 - protein, 126 aa, Artificial Sequence
  Description of Artificial Sequence: Synthetic coding sequence
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAP

SEQ ID NO: 14337 - protein, 540 aa, Artificial Sequence; identical to SEQ ID NO: 14332
  Description of Artificial Sequence: Synthetic coding sequence

SEQ ID NO: 14338 - protein, 232 aa, Artificial Sequence
  Description of Artificial Sequence: Synthetic coding sequence
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKD

SEQ ID NO: 14339 - protein, 831 aa, Artificial Sequence
  Description of Artificial Sequence: Synthetic coding sequence
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQHSHNHLNSENQTVTSVSTKRNHKCDPEKETVEVSVKSDDKHMHDHNHRLRHHHRLHHHLDHNNTHHFHNDSITPSERGEPSNEPSTETNKTQEQSDVKLPKGKRKKKGRKSNENSEVITPGFPPNHDQGEQYEHNRVHKPDRVHNPGHSHVHLPERNGHDPGRGHQDLDPDNEGELRHTRKREAPHVKNNAIISLRKDLNEDDHHHECLNVTQLLKYYGHGANSPISTDLFTYLCPALLYQIDSRLCIEHFDKLLVEDINKDKNLVPEDEANIGASAWICGIISITVISLLSLLGVILVPIINQGCFKFLLTFLVALAVGTMSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 14340 - protein, 831 aa, Artificial Sequence; identical to SEQ ID NO: 14339
  Description of Artificial Sequence: Synthetic coding sequence

SEQ ID NO: 14341 - protein, 38 aa, Artificial Sequence
  Description of Artificial Sequence: Synthetic coding sequence
MKVHMHTKFCLICLLTFIFHHCNHCHEEHDHGPEALHR

SEQ ID NO: 14342 - protein, 130 aa, Artificial Sequence
  Description of Artificial Sequence: Synthetic coding sequence
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQH

SEQ ID NO: 14343 - protein, 126 aa, Artificial Sequence
  Description of Artificial Sequence: Synthetic coding sequence
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSH

SEQ ID NO: 14344 - protein, 381 aa, Artificial Sequence
  Description of Artificial Sequence: Synthetic coding sequence
MSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 14345 - protein, 691 aa, Artificial Sequence
  Description of Artificial Sequence: Synthetic coding sequence
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKQGLSLVNGHVGHSHHLALNSELSDQAGRGKSASTIQLKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 14346 - protein, 690 aa, Artificial Sequence
  Description of Artificial Sequence: Synthetic coding sequence
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKGLSLVNGHVGHSHHLALNSELSDQAGRGKSASTIQLKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 14347 - protein, 654 aa, Artificial Sequence
  Description of Artificial Sequence: Synthetic coding sequence
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 14348 - protein, 611 aa, Artificial Sequence [sequence omitted]

SEQ ID NO: 14349 - protein, 557 aa, Artificial Sequence
  Description of Artificial Sequence: Synthetic coding sequence
MSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKQGLSLVNGHVGHSHHLALNSELSDQAGRGKSASTIQLKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 14350 - protein, 481 aa, Artificial Sequence
  Description of Artificial Sequence: Synthetic coding sequence
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMMEFCSVAQAGVQWCHLSSLQPLPLGLKRLSCLSLPSN

SEQ ID NO: 14351 - protein, 492 aa, Artificial Sequence
  Description of Artificial Sequence: Synthetic coding sequence
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 14352 - protein, 492 aa, Artificial Sequence
  Description of Artificial Sequence: Synthetic coding sequence
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGFGFLSVSLINLASLLGVLVLPCTEKAFFSRVLTYFIALSIGTLLSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 14353 - protein, 492 aa, Artificial Sequence; identical to SEQ ID NO: 14351
  Description of Artificial Sequence: Synthetic coding sequence

SEQ ID NO: 14354 - protein, 460 aa, Artificial Sequence
  Description of Artificial Sequence: Synthetic coding sequence
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKVTGRKTDFTFFMIQNAGMLTGFTAILLITLYAGEIELE

SEQ ID NO: 14355 - protein, 460 aa, Artificial Sequence; identical to SEQ ID NO: 14354
  Description of Artificial Sequence: Synthetic coding sequence

SEQ ID NO: 14356 - protein, 444 aa, Artificial Sequence
  Description of Artificial Sequence: Synthetic coding sequence
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKIIKWATDDIKSQLHLLWIYTAR

SEQ ID NO: 14357 - protein, 307 aa, Artificial Sequence
  Description of Artificial Sequence: Synthetic coding sequence
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKSSKEALSEVNATGVAMLFSAGTFLYVATVHVLPEVGGIGHSHKPDATGGRGLSRLEVAALVLGCLIPLILSVGHQH

SEQ ID NO: 14358 - protein, 307 aa, Artificial Sequence; identical to SEQ ID NO: 14357
  Description of Artificial Sequence: Synthetic coding sequence

SEQ ID NO: 14359 - protein, 896 aa, Artificial Sequence
  Description of Artificial Sequence: Synthetic coding sequence
MEMKLPGQEGFEASSAPRNIPSGELDSNPDPGTGPSPDGPSDTESKELGVPKDPLLFIQLNELLGWPQALEWRETGRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRLFGGLIQDVRRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 14360 - protein, 1259 aa, Artificial Sequence
  Description of Artificial Sequence: Synthetic coding sequence
MANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPHSGTPQKAKFSIGSDEDDSPGLPGRAAVTKPLPSVGPHTDKSPQHSSRPCSELRDGDGTTDLALSSPRLLCCLPSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLDAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 14361 - protein, 1232 aa, Artificial Sequence
  Description of Artificial Sequence: Synthetic coding sequence
MANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPHSGTPQKAKFSIGSDEDDSPGLPGRAAVTKPLPSVGPHTDKSPQHSSSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLDAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 14362 - protein, 400 aa, Artificial Sequence
  Description of Artificial Sequence: Synthetic coding sequence
MGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEPGGVPGCWSGAKWQLPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKH

SEQ ID NO: 14363 - protein, 1232 aa, Artificial Sequence; identical to SEQ ID NO: 14361
  Description of Artificial Sequence: Synthetic coding sequence

SEQ ID NO: 14364 - protein, 1232 aa, Artificial Sequence; identical to SEQ ID NO: 14361
  Description of Artificial Sequence: Synthetic coding sequence

SEQ ID NO: 14365 - protein, 1259 aa, Artificial Sequence; identical to SEQ ID NO: 14360
  Description of Artificial Sequence: Synthetic coding sequence

SEQ ID NO: 14366 - protein, 227 aa, Artificial Sequence
  Description of Artificial Sequence: Synthetic coding sequence
MTSPLEKDPEPNGALSPGPGDTNSWGFGRDPAPSPRDSLAPEDLEMFVLDFEDGDLWESIRGQLGPMAGPPTCHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKH

SEQ ID NO: 14367 - protein, 983 aa, Artificial Sequence
  Description of Artificial Sequence: Synthetic coding sequence
MEMKLPGQEGFEASSAPRNIPSGELDSNPDPGTGPSPDGPSDTESKELGVPKDPLLFIQLNELLGWPQALEWRETGSSSASLLLDMGEMPSITLSTHLHHRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRLFGGLIQDVRRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 14368 - protein, 945 aa, Artificial Sequence
  Description of Artificial Sequence: Synthetic coding sequence
MEMKLPGQEGFEASSAPRNIPSGELDSNPDPGTGPSPDGPSDTESKELGVPKDPLLFIQLNELLGWPQALEWRETGRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 14369 - protein, 959 aa, Artificial Sequence
  Description of Artificial Sequence: Synthetic coding sequence
MEMKLPGQEGFEASSAPRNIPSGELDSNPDPGTGPSPDGPSDTESKELGVPKDPLLFIQLNELLGWPQALEWRETGRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRLFGGLIQDVRRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 14370 - protein, 983 aa, Artificial Sequence; identical to SEQ ID NO: 14367
  Description of Artificial Sequence: Synthetic coding sequence

SEQ ID NO: 14371 - protein, 491 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTGSSTLAVALCSTVPSLALTSLLCLGFALCASVPILPLQYLTFILQVISRSFLYGSNAAFLTLAFPSEHFGKLFGLVMALSAVVSLLQFPIFTLIKGSLQNDPFYVNVMFMLAILLTFFHPFLVYRECRTWKESPSAIA

SEQ ID NO: 14372 - protein, 491 aa, Artificial Sequence; identical to SEQ ID NO: 14371
  Description of Artificial Sequence: Synthetic coding sequence

SEQ ID NO: 14373 - protein, 491 aa, Artificial Sequence; identical to SEQ ID NO: 14371
  Description of Artificial Sequence: Synthetic coding sequence

SEQ ID NO: 14374 - protein, 102 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARL

SEQ ID NO: 14375 - protein, 169 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSS

SEQ ID NO: 14376 - protein, 64 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQAGRL

SEQ ID NO: 14377 - protein, 148 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIG

SEQ ID NO: 14378 - protein, 119 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTS

SEQ ID NO: 14379 - protein, 491 aa, Artificial Sequence; identical to SEQ ID NO: 14371
  Description of Artificial Sequence: Synthetic coding sequence

SEQ ID NO: 14380 - protein, 22 aa, Artificial Sequence
  Description of Artificial Sequence: Synthetic coding sequence
MAGQGLPLHVATLLTGLLECLG

SEQ ID NO: 14381 - protein, 331 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLC

SEQ ID NO: 14382 - protein, 44 aa, Artificial Sequence
  Description of Artificial Sequence: Synthetic coding sequence
MAGQGLPLHVATLLTGLLECLGFAGVLFGWPSLVFVFKNEDYFK

SEQ ID NO: 14383 - protein, 2 aa, Artificial Sequence
  Description of Artificial Sequence: Synthetic coding sequence
MA

SEQ ID NO: 14384 - protein, 98 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTT

SEQ ID NO: 14385 - protein, 78 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQADCKAQDERFSLIFTLGS

SEQ ID NO: 14386 - protein, 107 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFF

SEQ ID NO: 14387 - protein, 110 aa, Artificial Sequence
  Description of Artificial Sequence: Synthetic coding sequence
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTT

SEQ ID NO: 14388 - protein, 585 aa, Artificial Sequence
  Description of Artificial Sequence: Synthetic coding sequence
MHCLGAEYLVFIMGYSVVAGAAGRLLFGYDSFGNMCGKKNSPVEGAPLSGQDMTLKKHVFFMNSCNLEVKGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 14389 - protein, 620 aa, Artificial Sequence
  Description of Artificial Sequence: Synthetic coding sequence
MHCLGAEYLVSAEGAPRQREWRPQIYRKCTDTAWLFLFFLFWTGLVFIMGYSVVAGAAGRLLFGYDSFGNMCGKKNSPVEGAPLSGQDMTLKKHVFFMNSCNLEVKGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 14390 - protein, 653 aa, Artificial Sequence
  Description of Artificial Sequence: Synthetic coding sequence
MHCLGAEYLVSAEGAPRQREWRPQIYRKCTDTAWLFLFFLFWTGLVFIMGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 14391 - protein, 163 aa, Artificial Sequence
  Description of Artificial Sequence: Synthetic coding sequence
MGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSG

SEQ ID NO: 14392 - protein, 617 aa, Artificial Sequence
  Description of Artificial Sequence: Synthetic coding sequence
MHCLGAEYLVFIMGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 14393 - protein, 605 aa, Artificial Sequence
  Description of Artificial Sequence: Synthetic coding sequence
MGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 14394 - protein, 719 aa, Artificial Sequence
  Description of Artificial Sequence: Synthetic coding sequence
MNDTEKPADTPSEEEDFGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFCEDLERNDGSTEKPYFVTPNLHGILIKKQLVPQKQKE

SEQ ID NO: 14395 - protein, 717 aa, Artificial Sequence
  Description of Artificial Sequence: Synthetic coding sequence
MNDTEKPADTPSEEEDFGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFLEDLERNDGSTARPYYVSQPLLKIFQEENPQTRKQ

SEQ ID NO: 14396 - protein, 589 aa, Artificial Sequence
  Description of Artificial Sequence: Synthetic coding sequence
MQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFCEDLERNDGSTEKPYFVTPNLHGILIKKQLVPQKQKE

SEQ ID NO: 14397 - protein, 712 aa, Artificial Sequence
  Description of Artificial Sequence: Synthetic coding sequence
TKAKKRPSNAGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFCEDLERNDGSTEKPYFVTPNLHGILIKKQLVPQKQKE

SEQ ID NO: 14398 - protein, 756 aa, Artificial Sequence
  Description of Artificial Sequence: Synthetic coding sequence
MSRVPQFKMQKSPAFCVDLAGSHRPELFLFGHLASHLFLCFFLEKPADTPSEEEDFGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFLEDLERNDGSTARPYYVSQPLLKIFQEENPQTRKQ

SEQ ID NO: 14399 - protein, 461 aa, Artificial Sequence
  Description of Artificial Sequence: Synthetic coding sequence
MKILFVEPAIFLSAFAMTLTGPLTTQYVYRRIWEETGNYTFSSDSNISECEKNKSSPIFAFQEEVQKKVSRFNLQMDISGLIPGLVSTFILLSISDHYGRKFPMILSSVGALATSVWLCLLCYFAFPFQLLIASTFIGAFCGNYTTFWGACFAYIVDQCKEHKQKTIRIAIIDFLLGLVTGLTGLSSGYFIRELGFEWSFLIIAVSLAVNLIYILFFLGDPVKECSSQNVTMSCSEGFKNLFYRTYMLFKNASGKRRFLLCLLLFTVITYFFVVIGIAPIFILYELDSPLCWNEVFIGYGSALGSASFLTSFLGIWLFSYCMEDIHMAFIGIFTTMTGMAMTAFASTTLMMFLARVPFLFTIVPFSVLRSMLSKVVRSTEQGTLFACIAFLETLGGVTAVSTFNGIYSATVAWYPGFTFLLSAGLLLLPAISLCVVKCTSWNEGSYELLIQEESSEDASDR

SEQ ID NO: 14400 - protein, 463 aa, Artificial Sequence
  Description of Artificial Sequence: Synthetic coding sequence
MKILFVEPAIFLSAFAMTLTGPLTTQYVYRRIWEETGNYTFSSDSNISECEKNKSSPIFAFQEEVQKKVSRFNLQMDISGLIPGLVSTFILLSISDHYGRKFPMILSSVGALATSVWLCLLCYFAFPFQLLIASTFIGAFCGNYTTFWGACFAYIVDQCKEHKQKTIRIAIIDFLLGLVTGLTGLSSGYFIRELGFEWSFLIIAVSLAVNLIYILFFLGDPVKECSSQNVTMSCSEGFKNLFYRTYMLFKNASGKRRFLLCLLLFTVITYFFVVIGIAPIFILYELDSPLCWNEVFIGYGSALGSASFLTSFLGIWLFSYCMEDIHMAFIGIFTTMTGMAMTAFASTTLMMFLARVPFLFTIVPFSVLRSMLSKVVRSTEQGTLFACIAFLETLGGVTAVSTFNGIYSATVAWYPGFTFLLSAGLLLLPAISLCVVKCTSWNEGSYELLIQEESSEDASDRAC

SEQ ID NO: 14401 - protein, 150 aa, Artificial Sequence
  Description of Artificial Sequence: Synthetic coding sequence
MAPSRLQLGLRAAYSGISSVAGFSIFLVWTVVYRQPGTAAMGGLAGVLALWVLVTHVMYMQDYWRTWLKGLRGFFFVGVLFSAVSIAAFCTFLVLAITRHQSLTDPTSYYLSSVWSFISFKWAFLLSLPKCWDYRCEPPCPAWICFLSTQ

SEQ ID NO: 14402 - protein, 146 aa, Artificial Sequence
  Description of Artificial Sequence: Synthetic coding sequence
MAPSRLQLGLRAAYSGISSVAGFSIFLVWTVVYRQPGTAAMGGLAGVLALWVLVTHVMYMQDYWRTWLKGLRGFFFVGVLFSAVSIAAFCTFLVLAITRHQSLTDPTSYYLSSVWSFISFKWAFLLSLYAHRYRADFADISILSDF

SEQ ID NO: 14403 - protein, 89 aa, Artificial Sequence
  Description of Artificial Sequence: Synthetic coding sequence
MYMQDYWRTWLKGLRGFFFVGVLFSAVSIAAFCTFLVLAITRHQSLTDPTSYYLSSVWSFISFKWAFLLSLYAHRYRADFADISILSDF

SEQ ID NO: 14404 - protein, 89 aa, Artificial Sequence; identical to SEQ ID NO: 14403
  Description of Artificial Sequence: Synthetic coding sequence

SEQ ID NO: 14405 - protein, 36 aa, Artificial Sequence
  Description of Artificial Sequence: Synthetic coding sequence
MYMQDYWRTWLKGLRGFFFVGVLFSAVSIAAFCTFL

SEQ ID NO: 14406 - protein, 16 aa, Artificial Sequence
  Description of Artificial Sequence: Synthetic coding sequence
MYMQDYWRTWLKGLRG

SEQ ID NO: 14407 - protein, 580 aa, Artificial Sequence
  Description of Artificial Sequence: Synthetic coding sequence
MAFHVEGLIAIIVFYLLILLVGIWAAWRTKNSGSAEERSEAIIVGGRDIGLLVGGFTMTATWVGGGYINGTAEAVYVPGYGLAWAQAPIGYSLSLILGGLFFAKPMRSKGYVTMLDPFQQIYGKRMGGLLFIPALMGEMFWAAAIFSALGATISVIIDVDMHISVIISALIATLYTLVGGLYSVAYTDVVQLFCIFVGLWISVPFALSHPAVADIGFTAVHAKYQKPWLGTVDSSEVYSWLDSFLLLMLGGIPWQAYFQRVLSSSSATYAQVLSFLAAFGCLVMAIPAILIGAIGASTDWNQTAYGLPDPKTTEEADMILPIVLQYLCPVYISFFGLGAVSAAVMSSADSSILSASSMFARNIYQLSFRQNASDKEIVWVMRITVFVFGASATAMALLTKTVYGLWYLSSDLVYIVIFPQLLCVLFVKGTNTYGAVAGYVSGLFLRITGGEPYLYLQPLIFYPGYYPDDNGIYNQKFPFKTLAMVTSFLTNICISYLAKYLFESGTLPPKLDVFDAVVARHSEENMDKTILVKNENIKLDELALVKPRQSMTLSSTFTNKEAFLDVDSSPEGSGTEDNLQ

SEQ ID NO: 14408 - protein, 580 aa, Artificial Sequence; identical to SEQ ID NO: 14407
  Description of Artificial Sequence: Synthetic coding sequence

SEQ ID NO: 14409 - protein, 475 aa, Artificial Sequence
  Description of Artificial Sequence: Synthetic coding sequence
MRSKGYVTMLDPFQQIYGKRMGGLLFIPALMGEMFWAAAIFSALGATISVIIDVDMHISVIISALIATLYTLVGGLYSVAYTDVVQLFCIFVGLWISVPFALSHPAVADIGFTAVHAKYQKPWLGTVDSSEVYSWLDSFLLLMLGGIPWQAYFQRVLSSSSATYAQVLSFLAAFGCLVMAIPAILIGAIGASTDWNQTAYGLPDPKTTEEADMILPIVLQYLCPVYISFFGLGAVSAAVMSSADSSILSASSMFARNIYQLSFRQNASDKEIVWVMRITVFVFGASATAMALLTKTVYGLWYLSSDLVYIVIFPQLLCVLFVKGTNTYGAVAGYVSGLFLRITGGEPYLYLQPLIFYPGYYPDDNGIYNQKFPFKTLAMVTSFLTNICISYLAKYLFESGTLPPKLDVFDAVVARHSEENMDKTILVKNENIKLDELALVKPRQSMTLSSTFTNKEAFLDVDSSPEGSGTEDNLQ

SEQ ID NO: 14410 - protein, 659 aa, Artificial Sequence
  Description of Artificial Sequence: Synthetic coding sequence
MASTVSPSTIAETPEPPPLSDHIRNAADISVIVIYFLVVMAVGLWAMLKTNRGTIGGFFLAGRDMAWWPMGASLFASNIGSNHYVGLAGTGAASGVATVTFEWTSSVMLLILGWIFVPIYIKSGVMTMPEYLKKRFGGERLQVYLSILSLFICVVLLISADIFAGAIFIKLALGLDLYLAIFILLAMTAVYTTTGGLASVIYTDTLQTIIMLIGSFILMGFAFNEVGGYESFTEKYVNATPSVVEGDNLTISASCYTPRADSFHIFRDAVTGDIPWPGIIFGMPITALWYWCTNQVIVQRCLCGKDMSHVKAACIMCAYLKLLPMFLMVMPGMISRILYTDMVACVVPSECVKHCGVDVGCTNYAYPTMVLELMPQGLRGLMLSVMLASLMSSLTSIFNSASTLFTIDLYTKMRKQASEKELLIAGRIFVLLLTVVSIVWVPLVQVSQNGQLIHYTESISSYLGPPIAAVFVLAIFCKRVNEQGAFWGLMVGLAMGLIRMITEFAYGTGSCLAPSNCPKIICGVHYLYFSIVLFFGSMLVTLGISLLTKPIPDVHLYRLCWVLRNSTEERIDIDAEEKSQEETDDGVEEDYPEKSRGCLKKAYDLFCGLQKGPKLTKEEEEALSKKLTDTSERPSWRTIVNINAILLLAVVVFIHGYYA

SEQ ID NO: 14411 - protein, 611 aa, Artificial Sequence
  Description of Artificial Sequence: Synthetic coding sequence
MVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 14412 - protein, 566 aa, Artificial Sequence
  Description of Artificial Sequence: Synthetic coding sequence
MTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGAHVYEERHQVSVSRTDDVGCVVPSECLRACGAEVGCSNIAYPKLVMELMPIGLRGLMIAVMLAALMSSLTSIFNSSSTLFTMDIWRRLRPRSGERELLLVGRTGIPSTPPAPQSRLSFLLPETPPLERYLLGLVVMDLWLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 14413 - protein, 566 aa, Artificial Sequence; identical to SEQ ID NO: 14412
  Description of Artificial Sequence: Synthetic coding sequence

SEQ ID NO: 14414 - protein, 569 aa, Artificial Sequence
  Description of Artificial Sequence: Synthetic coding sequence
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 14415 - protein, 596 aa, Artificial Sequence
  Description of Artificial Sequence: Synthetic coding sequence
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 14416 - protein, 612 aa, Artificial Sequence
  Description of Artificial Sequence: Synthetic coding sequence
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGAHVYEERHQVSVSRTDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 14417 - protein, 560 aa, Artificial Sequence
  Description of Artificial Sequence: Synthetic coding sequence
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 14418 - protein, 675 aa, Artificial Sequence
  Description of Artificial Sequence: Synthetic coding sequence
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 14419 - protein, 640 aa, Artificial Sequence
  Description of Artificial Sequence: Synthetic coding sequence
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 14420 - protein, 519 aa, Artificial Sequence
  Description of Artificial Sequence: Synthetic coding sequence
MVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSDCPADSGCQEPVPCQRRCSDGCIPEGAAPLHNGVPWDGQPHPLPRSSGLCRSRDLPEDLQQPLRLFGHRVSQTRAGTPAHSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 14421 - protein, 611 aa, Artificial Sequence; identical to SEQ ID NO: 14411
  Description of Artificial Sequence: Synthetic coding sequence

SEQ ID NO: 14422 - protein, 605 aa, Artificial Sequence
  Description of Artificial Sequence: Synthetic coding sequence
MESGTSSPQPPQLDPLDAFPQKGLEPGDIAVLVLYFLFVLAVGLWSTVKTKRDTVKGYFLAGGDMVWWPGLFSVLMLAWIFLPIYIAGQVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 14423 - protein, 706 aa, Artificial Sequence
  Description of Artificial Sequence: Synthetic coding sequence
MSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNMRKSRSGGDRGIHPRSHGRTGVRSQATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 14424 - protein, 166 aa, Artificial Sequence
  Description of Artificial Sequence: Synthetic coding sequence
MGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISGSCWW

SEQ ID NO: 14425 - protein, 681 aa, Artificial Sequence
  Description of Artificial Sequence: Synthetic coding sequence
MSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 14426 - protein, 173 aa, Artificial Sequence
  Description of Artificial Sequence: Synthetic coding sequence
  MOD_RES (1)..(1): Any amino acid
XSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISGSCWW

SEQ ID NO: 14427 - protein, 635 aa, Artificial Sequence
  Description of Artificial Sequence: Synthetic coding sequence
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLAFGYGLLCLGMAYISSQMGPVLQAAISIFGMVGGPLLGLFCLGMFFPCANPPGAVVGLLAGLVMAFWIGIGSIVTSMGSSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 14428 - protein, 147 aa, Artificial Sequence
  Description of Artificial Sequence: Synthetic coding sequence
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTV

SEQ ID NO: 14429 - protein, 635 aa, Artificial Sequence; identical to SEQ ID NO: 14427
  Description of Artificial Sequence: Synthetic coding sequence

SEQ ID NO: 14430 - protein, 193 aa, Artificial Sequence
  Description of Artificial Sequence: Synthetic coding sequence
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTAL

SEQ ID NO: 14431 - protein, 78 aa, Artificial Sequence
  Description of Artificial Sequence: Synthetic coding sequence
MSVGVSTSAPLSPTSGTSVGMSTFSIMDYVVFVLLLVLSLAIGLYHACRGWGRHTVGELLMADRKMGCLPVALSLLAT

SEQ ID NO: 14432 - protein, 115 aa, Artificial Sequence
  Description of Artificial Sequence: Synthetic coding sequence
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAH

SEQ ID NO: 14433 - protein, 59 aa, Artificial Sequence
  Description of Artificial Sequence: Synthetic coding sequence
MSVGVSTSAPLSPTSGTSVGMSTFSIMDYVVFVLLLVLSLAIGLYHACRGWGRHTVGEL

SEQ ID NO: 14434 - protein, 39 aa, Artificial Sequence
  Description of Artificial Sequence: Synthetic coding sequence
MSVGVSTSAPLSPTSGTSVGMSTFSIMDYVVFVLLLVLS

SEQ ID NO: 14435 - protein, 133 aa, Artificial Sequence
  Description of Artificial Sequence: Synthetic coding sequence
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYL

SEQ ID NO: 14436 - protein, 27 aa, Artificial Sequence
  Description of Artificial Sequence: Synthetic coding sequence
MSVGVSTSAPLSPTSGTSVGMSTFSIM

SEQ ID NO: 14437 - protein, 153 aa, Artificial Sequence
  Description of Artificial Sequence: Synthetic coding sequence
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQM

SEQ ID NO: 14438 - protein, 581 aa, Artificial Sequence
  Description of Artificial Sequence: Synthetic coding sequence
MERQNQCIQSWKRRRKMAPWSGGTGTTRWSLCNVWRFPYLCYKNGGGAFFIPYLVFLFTCGIPVFLLETALGQYTSQGGVTAWRKICPIFEGIGYASQMIVILLNVYYIIVLAWALFYLFSSFTIDLPWGGCYHEWNTEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYRDCIALCFLNSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 14439 - protein, 602 aa, Artificial Sequence
  Description of Artificial Sequence: Synthetic coding sequence
MDSRVSGTTSNGETKPVYPVMEKKEEDGTLERGHWNNKMEFVLSVAGEIIGLGNVWRFPYLCYKNGGGAFFIPYLVFLFTCGIPVFLLETALGQYTSQGGVTAWRKICPIFEGIGYASQMIVILLNVYYIIVLAWALFYLFSSFTIDLPWGGCYHEWNTEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYRDCIALCFLNSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 14440 - protein, 97 aa, Artificial Sequence
  Description of Artificial Sequence: Synthetic coding sequence
MDSRVSGTTSNGETKPVYPVMEKKEEDGTLERGHWNNKMEFVLSVAGEIIGLGNVWRFPYLCYKNGGGEMRALVPPHPLLEGGYFHLLHLRPLWGVP

SEQ ID NO: 14441 - protein, 510 aa, Artificial Sequence
  Description of Artificial Sequence: Synthetic coding sequence
MDSRVSGTTSNGETKPVYPVMEKKEEDGTLERGHWNNKMEFVLSVAGEIIGLGNVWRFPYLCYKNGGEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYRDCIALCFLNSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 14442 - protein, 730 aa, Artificial Sequence
  Description of Artificial Sequence: Synthetic coding sequence
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGGGAYLLPYLILLMVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKIIYFSSLFPYVVLICFLIRAFLLNGSIDGIRHMFTPKLEIMLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLIFVQRSGNYFVTMFDDYSATLPLLIVVILENIAVCFVYGIDKFMEDLKDMLGFAPSRYYYYMWKYISPLMLLSLLIASVVNMGLSPPGYNAWIEDKASEEFLSYPTWGLVVCVSLVVFAILPVPVVFIVRRFNLIDDSSGNLASVTYKRGRVLKEPVNLEGDDTSLIHGKIPSEMPSPNFGKNIYRKQSGSPTLDTAPNGRYGIGYLMADIMPDMPESDL

SEQ ID NO: 14443 - protein, 249 aa, Artificial Sequence
  Description of Artificial Sequence: Synthetic coding sequence
MFTPKLEIMLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLILCNALEITLLQCLMIILLHCLC

SEQ ID NO: 14444 - protein, 289 aa, Artificial Sequence
  Description of Artificial Sequence: Synthetic coding sequence
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGGGAYLLPYLILLMVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKVSMLEPFLILLITISGFIPLSNSVTDFCGQITHNTSF

SEQ ID NO: 14445 - protein, 96 aa, Artificial Sequence
  Description of Artificial Sequence: Synthetic coding sequence
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGG

SEQ ID NO: 14446 - protein, 623 aa, Artificial Sequence
  Description of Artificial Sequence: Synthetic coding sequence
MVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKIIYFSSLFPYVVLICFLIRAFLLNGSIDGIRHMFTPKLEIMLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLIFVQRSGNYFVTMFDDYSATLPLLIVVILENIAVCFVYGIDKFMEDLKDMLGFAPSRYYYYMWKYISPLMLLSLLIASVVNMGLSPPGYNAWIEDKASEEFLSYPTWGLVVCVSLVVFAILPVPVVFIVRRFNLIDDSSGNLASVTYKRGRVLKEPVNLEGDDTSLIHGKIPSEMPSPNFGKNIYRKQSGSPTLDTAPNGRYGIGYLMADIMPDMPESDL

SEQ ID NO: 14447 - protein, 736 aa, Artificial Sequence
  Description of Artificial Sequence: Synthetic coding sequence
MKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKISDVYNMSVWSLAGGQVLSNTGIGLGSVASLASYMPQSNNCLSDAFLVSVINLLTLLVFTSFNFCVLGFWATVITHRCCERNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTSKEVLRPYPPWALLLMITLFAIVILPIPAYFVYCRIHRIPFRPKSGDGPMTASTSLPLSHQLTPSKEVQKEEILQVDETKYPSTCNVTS

SEQ ID NO: 14448 - protein, 659 aa, Artificial Sequence
  Description of Artificial Sequence: Synthetic coding sequence
MKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKISDVYNMSVWSLAGGQVLSNTGIGLGSVASLASYMPQSNNCLSDAFLVSVINLLTLLVFTSFNFCVLGFWATVITHRCCERNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTVSLPQDPEPLWE

SEQ ID NO: 14449 - protein, 727 aa, Artificial Sequence
  Description of Artificial Sequence: Synthetic coding sequence
MPKNSKVTQREHSSEHVTESVADLLALEEPVDYKQSVLNVAGEAGGKQKAVEEELDAEDRPAWNSKLQYILAQIGFSVGLGNIWRFPYLCQKNGGGAYLVPYLVLLIIIGIPLFFLELAVGQRIRRGSIGVWHYICPRLGGIGFSSCIVCLFVGLYYNVIIGWSIFYFFKSFQYPLPWSECPVVRNGSVAVVEAECEKSSATTYFWYREALDISDSISESGGLNWKMTLCLLVAWSIVGMAVVKGIQSSGKVMYFSSLFPYVVLACFLVRGLLLRGAVDGILHMFTPKLDKMLDPQVWREAATQVFFALGLGFGGVIAFSSYNKQDNNCHFDAALVSFINFFTSVLATLVVFAVLGFKANIMNEKCVVENAEKILGYLNTNVLSRDLIPPHVNFSHLTTKDYMEMYNVIMTVKEDQFSALGLDPCLLEDELDKSVQGTGLAFIAFTEAMTHFPASPFWSVMFFLMLINLGLGSMIGTMAGITTPIIDTFKVPKEMFTVGCCVFAFLVGLLFVQRSGNYFVTMFDDYSATLPLTLIVILENIAVAWIYGTKKFMQELTEMLGFRPYRFYFYMWKFVSPLCMAVLTTASIIQLGVTPPGYSAWIKEEAAERYLYFPNWAMALLITLIVVATLPIPVVFVLRHFHLLSDGSNTLSVSYKKGRMMKDISNLEENDETRFILSKVPSEAPSPMPTHRSYLGPGSTSPLETSGNPNGRYGSGYLLASTPESEL

SEQ ID NO: 14450 - protein, 727 aa, Artificial Sequence; identical to SEQ ID NO: 14449
  Description of Artificial Sequence: Synthetic coding sequence

SEQ ID NO: 14451 - protein, 501 aa, Artificial Sequence
  Description of Artificial Sequence: Synthetic coding sequence
MVRKPVVSTISKGGYLQGNVNGRLPSLGNKEPPGQEKVQLKRKVTLLRGVSIIIGTIIGAGIFISPKGVLQNTGSVGMSLTIWTVCGVLSLFGALSYAELGTTIKKSGGHYTYILEVFGPLPAFVRVWVELLIIRPAATAVISLAFGRYILEPFFIQCEIPELAIKLITAVGITVVMVLNSMSVSWSARIQIFLTFCKLTAILIIIVPGVMQLIKGQTQNFKDAFSGRDSSITRLPLAFYYGMYAYAGWFYLNFVTEEVENPEKTIPLAICISMAIVTIGYVLTNVAYFTTINAEELLLSNAVAVTFSERLLGNFSLAVPIFVALSCFGSMNGGVFAVSRLFYVASREGHLPEILSMIHVRKHTPLPAVIVLHPLTMIMLFSGDLDSLLNFLSFARWLFIGLAVAGLIYLRYKCPDMHRPFKVPLFIPALFSFTCLFMVALSLYSDPFSTGIGFVITLTGVPAYYLFIIWDKKPRWFRIMSEKITRTLQIILEVVPEEDKL

SEQ ID NO: 14452 - protein, 470 aa, Artificial Sequence
  Description of Artificial Sequence: Synthetic coding sequence
MDRGEKIQLKRVFGYWWGTSFLLINIIGAGIFVSPKGVLAYSCMNVGVSLCVWAGCAILAMTSTLCSAEISISFPCSGAQYYFLKRYFGSTVAFLNLWTSLFLGSGVVAGQALLLAEYSIQPFFPSCSVPKLPKKCLALAMLWIVGILTSRGVKEVTWLQIASSVLKVSILSFISLTGVVFLIRGKKENVERFQNAFDAELPDISHLIQAIFQGYFAYSGGACFTLIAGELKKPRTTIPKCIFTALPLVTVVYLLVNISYLTVLTPREILSSDAVAITWADRAFPSLAWIMPFAISTSLFSNLLISIFKSSRPIYLASQEGQLPLLFNTLNSHSSPFTAVLLLVTLGSLAIILTSLIDLINYIFFTGSLWSILLMIGILRRRYQEPNLSIPYKVFLSFPLATIVIDVGLVVIPLVKSPNVHYVYVLLLVLSGLLFYIPLIHFKIRLAWFEKMTCYLQLLFNICLPDVSEE

SEQ ID NO: 14453 - protein, 433 aa, Artificial Sequence
  Description of Artificial Sequence: Synthetic coding sequence
MDRGEKIQLKRVFGYWWGTSFLLINIIGAGIFVSPKGVLAYSCMNVGVSLCVWAGCAILAMTSTLCSAEISISFPCSGAQYYFLKRYFGSTVAFLNLWTSLFLGSGVVAGQALLLAEYSIQPFFPSCSVPKLPKKCLALAMLWIVGILTSRGVKEVTWLQIASSVLKVSILSFISLTGVVFLIRGKKENVERFQNAFDAELPDISHLIQAIFQGYFAYSGELKKPRTTIPKCIFTALPLVTVVYLLVNISYLTVLTPREILSSDAVAITWADRAFPSLAWIMPFAISTSLFSNLLISIFKSSRPIYLASQEGQLPLLFNTLNSHSSPFTAVLLLVTLGSLAIILTSLIDLINYIFFTGSLWSILLMIGILRRRYQEPNLSIPYKSLILVVQAGEAGVQWHDLGLLQPLLPGFKRFSCLSLPSSWDYRCFCHFH
